United States Patent 12,746,261 (PROBIOTIC BACILLUS COMPOSITIONS AND METHODS OF USE) - sequence listing, part 13

SEQ ID NO: 261 - DNA, 4063573 bp, Bacillus amyloliquefaciens (residues 1-2,031,787 of 4,063,573)
gatacatcgcaatttgtcttgggaaagccactgatttcgtacgctttttcgctttgaaatcttcaagcttaatgttgaactgctgtccgacaatccgctgaatctcttttatcgtaatgaccttcggcttagaagacggaataatatctttcaatgcttctgcagccaggtctgcgttaatgtctttattgattaaggatgaataggcgacaacccggattaatgccccttccagttcgcggatgttgctgtcaatctgattggcgatgtaaagcatgacctcgttcggaatatcaaggccctccgccttcgctttctttctcagaatggcaatccgcgtttccagatccggcggtgtgatgtctgtaatcaatccccattcgaaccgcgaacgcaggcggtcttcaagggtcgggatctctttcggcggtctgtcactggaaatcacgatttgtttgctttcttcatgaagtgtgttgaatgtatggaaaaactcttcctgtgtttgttcttttccggctaaaaattgaatatcatctatcaaaagtacatcaacgttccggtagcggttgcggaaatcaacggctttattatcgcggattgagttgatgaattcatttgtgaatttttcagaagacaggtacaccactttggctgaaggattatgatcaatgacataatggccgatcgcgtgcattaagtgggtttttcctaaaccgactcccccgtatataaataaagggttgtacgctttagcgggtgcttccgccacagccagtgatgctgcatgggcgaatcggtttcccgatccgatgacgaatgtgtcgaatgtatatttcgggttgagcatgctttggggaaaatcagacggttcctcttttgccgcttttttcacttgcggtttcggcaaaaagtcttcttcgtcctgattttgaggaatgacaaatttgacgctcaattcttccccggttaattcatatatggtatctgcaatgagatgtaagtacctggactccagccagtctctggcaaattcattgggagcggtgatggttaaggtatctccttgcagcgaatgggctttcgtcgacttcatccaagtttcgaaactcggtttgcttagctttttctcaatttgagctagagcttgattccaaagatccaatatattctccattatccggcacagccctccttttctttaaaaatcagcgcccttcccctgttatagaacacaaaaaaagagcatatggctctgaccattcgtacacacgaaatgttgaaaacatatagtatagtagaaaaatagcttttcgacaaattccacaagttgtggacaacaatctacacaagctgtgtgaaaacaatccacaacttatccacaatttgtggataaagagaatggactggataagtaattaagagttaaaacacaaatataatatcaaattaagcgaggacttgcaatggttctcgtaatcttatccacaaacctgacaacttgttgaaaaatctttgtccacaggggttagcaatgtgaaaatgttgtcgataacgattgtggatattaaaaaaagaccgaaaaattatccacatgtcgttttttcgggggagcgcggctttttttgtgcgttaaaaaaaggaatatgaaaaataaggtttctaatctggttaaggtatgttatcctattatggttgtaagaaataaaagcactgctgaagttgacaatgaataggcagcacaaatataataagtaagactgtctttaacagctattcctcgagggaggtgtcataaatgaaaagaacattccaaccgaataaccgtaaacgcagtaaagttcatggcttcagaagccgtatgagttcaaaaaacggtcgtctagtattagcacgccgtcgccgcaaaggcagaaaagtattatcagcttaggccactgaataatgtcagtggtcttttttcacattaagagaaaagagatgtcatgcgtcgcccggtactggagaaatttcttcagtattccggcggcccgttttttttagatagaaataaaagtttctgcgagtgaatatcggagtgaattaaagtgaagaagcgaaatcggttaaagaaaaatgaagattttcaaaaagtgtttaaacgcggaacgtctatggcaaaccgccagttcgtgctgtatacgcttgatcagccgaaacaggaagagctccgggtagggctttctgtcagtaaaaaaatcggcaatgccgtcgtgcgcaatcgggtgaagcggttaatcaggcaggcggttcaggaggaaaaagagctgctcaagccgaaagattttattattatcgcaagaaaacccgccggcgacctcagttttgaagaaacgaaaaagagtctgcagcacttattcagaaaaacctcattatataagaaatcttcgtcaaaatagctcatattttgttttcttcacgtttttaaaagcgcttccttttatttggcgaaaaatgaacgccatttgaaactgaaagatgctaaaatacatacaaggtttataaagattggtataggaggaaacgttcttgaaaaggagaatatggttactactgagtatggtcggtatgctcgtgctgctggccgggtgctcgagtgtgaaagagccgattacggcgaatagtccgcatttctgggacaaatatgttgtgtatccattgtcagaagtcattacgtacgtagcgaaactgacgggcgataactatggtttgtcgatcatcatcgttacgattttaattcgtctgctgattctgccgctgatgatcaagcagcttcgaagctcaaaagcgatgcaggcgctgcagcctgaaatgcagaagctcagagaaaaatacagctctaaagatcaaaaaacgcagcagaagcttcagcaggaaacaatggccctgttttcaaagcacggggtaaacccgctggcgggatgtttcccgatcctgattcaaatgccgattttgatcggattctaccacgccattatgcgtacgcaagccatttcacagcacagctttttatggtttgatttaggagagaaggatccttactatattcttcctatcgttgccggtgtggccacttttgtccagcagaagctgatgatggcgggaaatccgactcagaatcctcaaatggcaatgatggtatggattatgccgatcatgatcatcgtatttgcgatcaacttcccgagcgcgctttctctgtattgggtagtcggaaacctgtttatgattgctcagacattccttattaaaggacctgacattaaacacgatccggaaacgcagaaagccggaggaaagaaaaagtgaagaaggtgactgctgcgggacggaatgtcgaagaagcagttcaatcaggccttcaggaacttcaactgacgaaagatcaagtagaaataacggtggtgcaagaagaatataaagggtttttgggtattttcggaaaaaagaatgcgattgtagaactggaagagaaaagaaatcctgttcaggaagcgaaagcgtatttagaagaaatcatccattccattgccgggccttctgagattgttacggaagaaaacaagaaaacagtctgttttcatattaaaggtgaaaaagcggcgctgcttattggcaaaagaggacaaacactcaatgccttggaaacattgacgcagcttgttttgaaccgcggctccggccagtatcgccaagccgttgtcgacgctgaaaattatcggcggaaaagaagagaaattctggatcagctggcaaacaggctggccaagcaagtgtcgaaaacgaaaaaagaggtgcatttagaaccgatgccgtcaggtgaaagaaaaatcatccatgacgcgctgtcaaagcatccaaatatcaaaacgttttctaccggtgaaggccggtaccgccatctcgttatttcccataaagatagcagaaaaccgaagtccgggtaaaatcggaacttcggtttttttattggtaaaaatggctctattcctgagcagaatcgcattttttgcgtttaagttttttctttttaggtctatgctgttgataaaaaaggttttaggaaataaaattaattgttattcacatgtggataagttaaagtaataagggatgaatttctgcctttgtggataacgtatcttccacttcaaaccaaactatgttatcttttaattttggcgtaaataaaattttttatatagatggaaacagagataaagagaggtgaacagtatggatacaattgcagcgatttcaactccgatgggtgaaggcgcgattgcgatcgttcggctgagcggcccggaagccgtaaagatcgccgacaaaatgtacaagggtccgaaaggcaaaacgctcagttcggcagaatcgcataccattcattacgggcatatcgcggacagtacgacgggacggattattgaggaagtcatggtgtctgttttaagagcgcccagaacattcacaagggaagatgtcattgaaatcaactgtcacgggggtattgtgacggttaatcaggtgctccagcttgctttaagagaaggtgcgagactggcagaacccggtgagtttacgaagcgcgcatttttaaacggacggattgacctttcacaggcggaagcggtgatggatctgatcagagccaaaacggaccgtgccatgaatgtcgccatgaaccagatggaaggacggctttccgcgcttgtccgccgtctgcgtgatgagttgttagaaacacttgcccatgttgaggtaaatatagattatccggaatatgatgacgtcgaagaaatgacgcatcagcttttagtggagaaggcaagcggcgtgaagaaagaaatcgaggcgctgctccgtacgtctgagcaggggaaaattttgcgtgagggactgtctaccgtgatcatcggccgtccgaacgtcgggaaatcctctctgcttaacagccttgtccatgaaacgaaggcgatcgtaaccgatattccgggaacgacgcgtgatgtgattgaggaatatgtcaacgtgcgaggcgtgccgcttcggcttgtcgataccgccggaatccgtgagacagaagacatcgtcgaaagaatcggtgtggaacggtcacggcaggttctgaaggaagcggatctcattttgcttgtgcttaaccacagcgaagcgctttctgaagaagatgtgaaattgtttgaagcggttgagggaatggacgtcattgtcattatgaataagacggaccttgaggctaagattgacgctgagcgcgtcaaggaactggcgaaaggccggcctgtcgtcacgacctcattgctgaaagaagaaggcattcaagatttagaggaagcgattcagtcgctattttatacaggagcgatcgaaagcggagatctcacctatgtcagcaacacccgtcatatttcgattctgcatcaggcaaagcaagcgattgatgatgcgctgaacgggattgaacaggatgttccgattgatatggtgcaaattgatttgacaaggtgctgggaactgctgggcgaaatcatcggtgatgccgttcacgaaagcttaattgatcagctcttttcacaattttgtttaggtaaataaaagggaggaaaaaaccatggggtatgaagcaggccaatacgacgtgattgtcatcggcgccgggcatgccggtgttgaggctgccctcgcatccgcgcgccagggagccaaaacgcttgttttgacgattaatcttgatatggttgcgtttatgccatgtaatccgtctgtcggcggccccgcgaaagggattgtcgtccgcgaaattgacgcgctcggcggagaaatggctagaaatatagataaaactcatattcaaatgagaatgctgaatacaggaaaaggtccggccgtacgggcgctgcgtgcgcaggcggataaattccaatatcagcacgaaatgaagcatacgctggaaaaaacaccgaatttgacacttcttcaagggattgccgagcgtttaatcattgaagacggagagtgccgcggtgtcattacgcaaaccggtgctgaatacaaggcaaaaacggtcgtgctgacaaccggaacgtatttaagagggcggatcattctcggggatctgtcttactcaagcggtccgaataaccagcagccgtctattaaactttctgagcacttagaggagctcggttttgatctcgtccgttttaaaacgggcacgcctcctcgtgtctcaagcgattccattgattacagcaaaacagaaatccagccgggggacccggttccgcgcgctttctcatatgaaacggttgaatacattaccgatcagctgccttgctggctgacttacacgagtcctgagactcatgagatcatcgacagcaacctgcatcgttcgccgatgtattccggtatgattaaaggaacgggaccgagatactgcccttcgattgaagataaagtcgttcggtttaatgataaaccgcgccatcagattttccttgagccggaaggcagaaatacgcaggaagtatacgttcagggtctatccacgagtcttcctgaggacgtgcagcagcggatgctggcgaccattccgggactggaaaaggtgcagatgatgagagccggatacgcgattgagtatgacgcgattgtaccgacgcagctctggcctacactggagacgaaaaaaatccctaacctgtacacagccggtcaaattaacggtacatcaggttatgaggaagcagccgggcaaggaattatggcagggatcaacgcaggccgcaaagcgcttggaaaagaagaagtgatcctcagccgttccgatgcttatatcggtgtattgattgatgatttggtaacgaaaggaaccaatgaaccgtatcgtctgctgacttcacgggcggaatacagactgctgctccgtcacgacaacgcggatcttcgcctgacggaaatcggccatgagatcggcttaatttctgatgagcgctatgaagcgtttgagaagaaaaaagcggcgatcgaggcagagaaaaaacgtctctggtctgttattatcaagccgtctcctgagaatcaggaatatatccgttcactcggcggaagcgagctgaaagacggagtgcgcggcacagatttaatgaaacgtccggaaatgaactatgaaacagtgacaaaacttgcgcctgcagattctccggttccgcaagatgtggcggaacaagtggaaattcaggtgaaatatgaaggatatatcgaaaaatccttgcagcaagtggaaaagctgaagaaaatggaaaacaaaaaaatccctgatcggattgattatgacgccattaaaggaattgctactgaagcgcgtcaaaagctgaaagaagtgcgtcctttatcagttgctcaagcgtcccgtatttccggcgtcaatccggcagacatttcaatcctgctggtatacctggagcagggccgtattgccaaggtagctgaatagaaaggatgacggcatgaatatagagcaatttacatccagtttagcggagaaagggatttccctttctgaccgccagctggagcaattcgagttgtattaccggatgctcgtggaatggaacgaaaaaatgaatctgacatccatcactgagaaaaaggaagtttatctcaagcatttttatgattcgataacggcggcattttatattgattttgaaaaggtcaccactctttgtgacgtcggcgccggcgccggttttccaagcctgcccgtcaaaatctgcttcccgcatctgcatgtcaccatcgtcgattcactgaataagcggattacgtttttggaaactctctctgatgctttacaattagagcatacgacatttgtccatgacagagcggagacattcggacagcggaaagacgtccgggaaagcttcgatctcgtgacggcccgtgcggtggcgcgtctgtcggtcctgagtgagctttgtctgccgctggccaagaaaaacggtatttttgcggcattaaaagctgcagccgctgatgaagagctgaaagcggggcaaaaggcgattaaagtattgggaggagagcttgaacaagttcattcctttacacttcccgttgaagaaagtgaacggaacattatgatcattcgcaagacgaaaagcactccgaaaaaatatccgagaaaaccgggtactccaaataaatcgccaattgaagggtaatttagacagcctgatgtgacaattccatcatattttctgcaaaattgatgaagatacagcaggaaaaaccatgagaaaatagaattataaaaatggcagtttttaaaggtggtgtaggtacatgaagcattcattctctcgtttcttcgggtttggtgagaaggaagaggaaccggagatagctgagcatgatacaaacaaagaagagatactcgaaataccggtacatgctatcgttcccaaccgttttcagccacgcaccattttctcagatgaaaaaatcaaagagttagcaatgactatccatacacacggcatcattcagccgattgttgtcagacatacagaagatgaaggacaatatgagctcattgcgggtgaaaggcgctggagagcggtacagacgcttgaatgggagaagattcccgcaattattaaagatttttctgatacggaaacagcatctgtcgctttgattgaaaacctgcaaagggaagaattgtcctccattgaggaagctcatgcgtacgcaaggctgttagaacttcatgatttaacacaggaagccttggcgcagcgcttaggaaaaggccagtcaacgattgcgaacaagctccgattgttaaagctcccggaacccgtccaggatgcgattatggagaaaaaaattacggaacgtcatgcaagagcactgattccgctcaaacagccggagtttcaggtcacattgcttgcggaaatcattgagaaaagcttaaacgtcaagcagacagaagacagagtggtgaaaatgcttgaacagaataagcagaaaccaaagccgagacgcaaagcgttcagcagggatacaagaattgcgatgaatacgattcgtcagtcactgtccatggtggaagacagcggcgtcaggctgaacactgaagaagaagaattcgaagagtacatccagcttaccattcggatacctaaataaaaactctcctgatcagcaggggagtttttattttaatcaaaaaactattttgagataatgatagatttattgtgcactatacattatatatgtaaaattttatctttttgtgtcgtgaattgtctttttacagtcaaaaaagtcactttatcggagaacttatattagaaagtgtctttttcgtttacatttttttcacttgctgataaacaaattatgaaaaaaataaaacgctttactctttttttgataagatagaaacaagacagtacatgttcatgtgaaggtaggtgacatcgtgggaaaaatcatagcaattacgaaccaaaaaggcggagtcgggaagacgacgacttctgtcaatctgggggcttgcttggcttacataggtaaaagggttcttcttgttgatattgatccgcagggcaatgcaacgagcggattagggattgaaaaagccgatgtggatcattgtgtgtacgacattttagtagatgatgcagatgttacagatattattaaaccgacttcagtagagaacttagatgtcattccggccacgatccagcttgcgggagcggaaatcgaattggttccgacgatctcacgggaggtcaggctgaaaagagcattagaatctgtgaaacaaaattacgattacatgattattgattgtcctccgtctctcgggttattaacgattaatgcgcttaccgcttcagattcagtcgttatcccggttcagtgcgaatactacgctcttgaaggattgagtcaattattaaatacagttcggcttgtgcaaaaacatttaaataccgacttaatgatagaaggagtgcttctgacgatgcttgatgccagaacgaatctcggcattcaagtgatagaagaggtaaagaaatactttagagataaagtgtatcaaaccattattcctcgcaatgtccgtttaagtgaggcgccgagtcacggcaagccgatcatattatacgatccgcgttcgagaggtgcggaagtatatttagatttagcaaaggaagtggcagcgaatggctaaaggcgggctcggaaaagggattaacgcgttgtttaatcaggttgatttgtctgaagagacagtggaagaaattaaaatcagtgatttacgccccaatccttatcagccaagaaaacaatttgatgatgagtcattagctgaactgaaggaatccatcattcagcatggcattcttcagcccattatcgtgagaaaatcattgaagggctatgatattgtagccggcgaacgccgttaccgcgccgcaaaacttgccggtaaagagacagtgccggctatcgtgcgggatttatctgaatcgctgatgcgggaaatcgctcttttggaaaaccttcagcgtgaagacttatcaccgcttgaagaagctctggcatatgactcactgctgaagcatttggatttaacccaggaacagctcgctaaacggctcgggaaaagcaggcctcatattgccaaccatttaagactgctgacgctgccggaaagcatccagaacctcattgcagaaggtacgttatccatgggacacggcagaaccttgcttggcttgaaaaataaaaacaagcttgaaccgcttgtgaagaaagtggttgaagaacagctgaacgtccgccagcttgagcagctgattcagcagttaaacaacaatgttccacgtgaaacaaagaaaaaagaacctgttcaagatgttgtgttaaaagagcgggaatcgtatttgcaaaattacttcggaacaacagtcaatattaagagacaaaagaaaaaagggaagattgagattgagtttttctcaaatgaagatcttgaacgtatcctggaactattgtccgaaagagaagcgtaaaaaccatcttttttaaaaaagatggttttttatatacgtcttgtcagcttatgaaacggactgagccgttcctgccggccttctgatttatctgtcagctgtaacccctctgctaaaacatttgccatgctcataacaagatgaagcctcgtattctgcaggacaaaatactccataaacccgctgacattgacgattccattgatatggacgtcaccgatttcaggaaggtctttttgaacacctgctccgggcttcagcggcccatcgccgatttgaaatgagcctacgcttttgacgcggcctaaacaagcatcaaccgctataataaacggatttttatgtagatgttgaatatctttcagcttgtctttcatattgacggcgtgaacaggatctgacagcgtgccgtaaacgtgcaatctgcctaaattcattttttctaactttgttcctacgagcggacctaatgaatctccggtcgaccgatctgtaccgatacacacggtgactaacggtctgccggctgctttacgtaaagatgaagtaaggattgcttgtatttgattcgcagcagaagaatccgtatgggatacatattgttttgcccgttcttgagaaaaaagcccgccttttcgattcataaggttcacttccttgtcatgtcatacgagtattacattgttgtttttggtgatgtatggttgtttacagtatatccagcgctgcctttttttatgcttatgtcatgatgagcatgccggttgtttgaaaagagcggatagaaaaaagaactcagagcagttattctctaagttcatgaaagaaataagaccatatgatctacatcaacatattgctgatgatctaattccagcgctcttttttctgcagagaagaggataatcctaactgagcgcagagtttttttgcgggttccatttgttgaagtaacagagagatggagctgttctgtgtctttcatcttttttgcccggctgatggcttccgtcattaaagcttttcccgcgcctgaccctaggtgtttgggggaaatatacatagaaccgataaccgcaatgtgtcttagtttaaacagcagatgcttggagatcttgaggattcctatcaggctgtcttgttcaaaggcgccaagcaagatggcattgccggcttcaagcctggctttgcatttttcggacggcctcatagctgacggcgattgcgtccgggtgatcttttaaagctttgagcctgaatcggagtaaggctgggtatcacttgcggttaaacgcctgatgtccatgatttgagcgcctaacataaataaattttctgaatagtcaatcgtcgttatcataccatatttgtcccatttgtatgaatgtttgctgctgtcactcaatatagtagcaatatgcggagatgatcagaaattttatgaggtgatgagggtgtggagagccgggatgaagtggatgctgctcatattaagcagccagattggggccgggtatgcaagcgggcaggaaatatggcagtttttcggtgtcgaaagcggactggctattgtattgtttacagtcatgtttacgatttcggcttatattgtgttgaagatcagctatcgggttcaatcaacgcactttttacctgtgcttgagcatctgatgggaccggctcttgctaaagtctatgatgtgcttattatgttttatttgttttcaatgacgatggttatgattgccggcggcggtgtgacgctgcaaatgtacaagctgccgttttggatcggtatttttcttctttgcattgtgaccgtgggtttattcttttgggatataaaagggatattatctctgaatagtattttgataccgattcttgtagcggggctgttatatgcattggtcttttttcagacaacgcatcattacacgtggacgatagacttgacccgccagtataattggccggcaagcattaccttcacgtccttaaacattctttctgttgtcgctgttctttcttcaatcgggaaagatatgaagggactgggagaagccaaaatcgcaagcgttgcaagcgggctgattttcggtatgatttcatttgtttacaatgaaacgcttgtacagctttcaggcagtcttacacaatatgagattcctcttttcgccgtccttgaaggcgctccttatccgttatttctttgtatggccgccgtgctttttttagccatctatacgacaacggtgaccggtcttttcgggctgtccagccgcatgcttgcatttgtgaaattgccgagatggacgctcgtatctcttcttttagctgtgatggtgccttttacgacaatcggtttttcagatttgatcgccattttatatcccatttacgggcttttaagtctttatttgctggtatgtcttcttctttaccctattttagggagatggaaaaaagtataatgctcattttgagtgcggccgttgctcttatcctgtctttttttgtacaataaataaagcagtctatggagagaggtgaagggtcttggcggataaagactttggcctgaatgatattgttgaaatgaagaaaccgcatccttgcggtgaaaacaggtggaaaatcattcggatgggaatggatattcggatcaaatgcacgggttgttcccacagtgtcatgattccgagaagagattttgagagaaagctgaaaaaagtactcgtcaagcatgaggagcctacatcataagggctggcgctcatgctttttcatatagaggagaggaagaggcccgatgagcaaagtgcatcagtcagcgtgcccgctgaattgctgggacagctgcggctttttggtgacagttgaggatggaaaggtgacgaaagtagacggagacccgaatcatcccattacggaagggaaaatttgcggccggggcagaatgctggagacgaaaacgaatgcgccggaacggcttcgttttcctttaaaaaagaaagacggcgaatttgtccgcatttcctgggagcaggcgttagatgaaattgctgaaaaaatgacggtgattaaggagacgttgggcactgccgcagtgctgcacagtcatgactacgccaataacggtcttttgaaggcgctcgaccagcgttttttcaatggatacggcggtgtaaccgagattgcgggcagcatttgctggggttccggcattgaagcgcagcgctgggatttcgggcgttcttacgggcatggaccgcttgatatttatcacagcaagcatgtgatcgtatggggcagaaacgtgtcccggacgaatatgcacctctatcatcatctgcagcaggtgaagaaaaaaggagcgacactgacggtcattgaccctatttttaacccgactgcaaagcttgccgaccggtatatatccgtcaaacccggcatggatggctggcttgcggcgggtgttttaaaaatattatgccaaaccggcagaaccgattctgattttattcaaaagcattcggtcggttttgaggaaatagacaagcttctgcagacgatttcttttgaggagatcattgagaaaacagaaacgtctttagaagcgcttgaatatcttgccgatttatatgctgacggtcccgcctccacttttatgggtcttgggatgcagagatataaaaacgggggcgggacgatacggtggattgacgctttagctgcggcgagcggaaatgtcggtatcaaaggcggcggcgccaacttcggaaatgtgcaagtcggtgaaagctttgcaaaggccgagctcactcgtcctgatttgaagaaaagttcgagaacgttttcgatgatgactcaagctgaagaggcgctgaatgcagccgacccgccgattgagatgatcatcgtgacgtgcggcaatccgctgacacaggtgccgaatacaaaaaaagtgaaggaagcgtttgaaaaaacgccggtcacagtggccattgattcggtcatgaccgatacggcgaagctctgtgactatgtgctgccgacggccgttgttttcgaagaggaagatatttattattccagcatgtatcatcactatgttcaatatggtaagaagcttgcggaaccgcagggagaggcaaaatcagaccgctggatctggacggaactcgcaaagcgtctcggattcggggagctgtttgattacagtgcggaagatttcttaaaaatggggctctcttctttggagaaagaaggaatcacccttgagcaattaaaggaaaaaggacatatgccgcttccggttaaacaggttccgtggagtgattttcaatttttaaccccgagcggaaaatttgaattcgtctcgtcactggcagaagagaaaggatacagcggcctccctcaattggaagtgccggaggagtccgtttatcacgacgccggactggccgggaaatatccgtatacgctgctgtccattcacccgcagcgctccaatcattcacagcacgtgccgtttattgaaaagctccagcagattcaggtggacctgtcgccggatatcgccgaggagctttcacttcaagacggagatacggcagaggtatacaatgaccgcggccgtctgcgcggcagggtgaaaatcatgaagcaggctcacccgaagacggtgaatatagatgaaggcatgtgggcggcattcggaggctccgtcaacatgctcacaaaggattcaaattccgataatggaatgggaagtacgctttttgactgtctggtagcggttaaaaaagggtaatctaaggagagagagggcgggaaatgcttttttctcagcttgtcttttcctatgaacctccttataattgctctaggtttacaatacgtttatacgatgatggtttgatatagaggagatgaaagaatggctttaactgctggaattgtcggtttgccgaatgtcggaaaatcgacgttatttaatgcaattacccaggctggtgccgaatcagccaactacccgttctgtacaattgatccgaacgtgggaatcgtggaagtgccggatgaacgtctgcaaaagctgactgaattggtgaacccgaaaaaaacagtgccgactgcgtttgaattcactgatatcgcggggatcgtaaaaggcgcatctaaaggtgaaggactcggaaataagtttctttctcatatccgtcaggttgatgcgatctgccacgttgtacgtgcattcgctgatgacaatattacgcacgtgtcagggaaagtcgatccgattgacgatattgaaacgatcaatcttgaattgattcttgccgacatggagacagtcgaaaaacgcatcacgcgtgtaagcaagcttgcgaagcaaaaagacaaagaagcggtttttgaatttgacattctgtctaaattgaaagaagctttcgaacaagaaaagcctgcccgttccgttgaatttacggaagaacagcaaaagcttgtgaagcagcttcatttgcttacgtcaaaacccgtgctttatgtggcgaatgtaagcgaagatgaagtggctgatccttcagacaatgaatacgttgcgaaaatccgtgagtacgccgcgggtgaaaatgccgaagttatcgtcgtctgtgcgaaaattgagtctgaaattgctgaattggaaggcgaagaaaagcaaatgttccttgaggagctcggcatcgaagaatcaggtcttgatcagctgattaaagcgtcatactctcttctcggccttgcgacatactttacggcgggcgaacaggaagtgcgcgcatggacattcagaaaaggcatgaaagctcctgagtgtgcgggtatcatccacactgactttgaacgcggctttatccgcgctgaaacggttgcttatgaagaccttttggcaggcggcggaatgtccggagcgaaagaagccggaaaagtgcgtctggaaggtaaggaatatgtagtccaagacggagatgtcattcatttccgatttaatgtataggacacagttgtaaagggacaagagctttggtataatataaacttgtgagtaatagaattattgctccttgcccattatagggccgcttagaccaaaaggaggtgcaaacagatgaaaaagtacgaagttatgtacattatccgtccgaacattgacgaagagtcaaagaaggcagttatcgagcgtttcaacaacgtattgacttctaacggagcggagatcactggaacaaaagattggggtaaacgtcgtcttgcttacgaaatcaacgatttccgtgacggtttctaccaaatcttaaacgttcagtctgaagctgcagcggttgctgaattcgaccgtttagctaagatcagtgacgatatcattcgccacatcgttgttaaagaagaagaataagcaatttgaaatatataatgttaaaaggtggtctttcatatgcttaaccgagttgtattagtcggaagactgacaaaagacccagagcttcgttatacgccaagcggtgcggctgtcgccacgtttactcttgctgtgaatcgtacattcacgaaccagtccggagaacgtgaagccgatttcattaattgtgtcacttggagaagacaagccgaaaacgttgcaaactttcttaaaaaaggaagccttgccggcgtagacggccgactccagacaagaaattatgaaaatcagcagggacagcgtgtcttcgtgacagaagtccaagctgaaagtgttcaatttcttgagcctaaaaacagcggcggttctggatcaggcggatacaacgaaggaaacagcggcggaggccaatactttggcggaggccaaaatgataatccgttcggcggaaatcagaacaaccagagacgaaatcaagggaacagctttaatgatgatccatttgccaacgacggcaagccgattgacatctcggatgatgatcttccgttctaatagattatcgctatattcataacgagaaaggtgggaaatgacaatggcaggaggacgcagaggcggtcgtgcgaaacgccgtaaggtttgttacttcacttctaacggcattacgcacatcgattacaaagatgtagatcttcttagaaagtttgtttctgagcgtggtaaaatcttacctcgccgtgtaactggaacaaacgcgaaataccaacgtaaattgactatcgcgatcaaacgcgcacgtcaaatggctttacttccatacgtaactggcgagtaagccgaaagaaaagagcaagagcctgcgggctcctgctctttttttatatcagtcctcctccatcctgccgaaatgtttcacatgaaacatggaagtgctcctgacatctatctttgttatcttgctcctctattcaaatacgcgtacttatgcaatgaatttgtttatactgaagaacagggggtggctgagatggagacagacagaaatatcctgactgatgaaaagtggagcgcaatcatacgcaatgatgcttcttatgacggggcattttattatgcagtaaagacgacggggattttctgccggccttcttgtaaatcgagagctccgaataaagaaaacgtgctggtgtttgatacggctgatgcagcgcttgataaacattttcgtccctgtaaaaggtgccggccgaacggtcttcgtcttcctgatgaagaatggattgctcaaatcattgagtacattgaccgccattatcacgaatctctgactctgagtgtactggccgaaatgtgtcacggcagcccttatcatttacagcggacatttaaaaaaatcaggggaatatccccgattgagtatatacagaacataagattggcgaaggcggaacaccttttaaagcatactgatatgacagtcatggagattgctctgacggtcggaattccaaacacagcgcattttgccactctttttaaaaagagaaccgggaattcgcccacagaataccgaaaaactgccggaatgggacagggaggttcaatatgagtaaagagacaatggtctattggacacttttcacacggaatgattggagcctgtatacagccgccacatctaaagggctttgctttataggttcaaatcatggaagctttgaagagcttgagcagtgggcaaaaaaatcactgccgcaataccgattggcacgtgatgatgagaagctggcgtcttacacggcagagctgtccgagtacatcgaaaatggcagatcagctttttcagtgccggtggatctttacgggacagaatttcagcttgctgtatggaaagcgcttatggacataccgtacggcgagacatactcctattcggatatagcagaaatgattcagaaaccggcagccgtaagagccgtgggcgccgcaatcgggaaaaatccggtattgattacggttccgtgccatcgcgtcatcggaaaaaacggaaaactgaccggattcagaggcggtttagaaatgaaaaagcagatgctggcattagagggcggaaacattgaaacactggaatgccggctgagccggacaggggggaacacatgaaactgatttcttggaatgtaaacggcttacgtgccgtgatgaaaaagatagatatcaatacttacgttcaggaaacgaaagccgatattttatgtctgcaagaaacgaaagtacaggacggacaagtatcattacagcttgaagggtatcatgactattggaactacgcggtgaaaaaaggctactcaggcacggctgttttttcgaaagaaaagccgcttcacgtgttttatggactgggaattgacgatcatgatcaagaaggacgggtgatcacacttgaatttgagaacctgttcgtcgtcaactgttatacgccgaatgccaaacgcggattagagcgaattgattaccgtcttcaatgggaagccgattttaaggagtatctgcagaagcttgaccggaagaagcccgtgatattatgcggcgatctgaatgtcgcacacagggagatagatttaaaaaatccgaaagccaaccggaagaacgccggtttctcggatcaggagcgggaagcgttcagcgccctgctgaacaccggatttaccgactcattccgctatttatatcctgatcgggaaggcgcctattcctggtggtcttacaggacgaacgcacgtgagaaaaacatcggctggcggcttgattacgtcattgtttcagacagactgaagccgcggatcagcgaagcggccatttgcgccgatatcatgggttctgaccattgccctgttgaaatgacagtggatttatgatgagatagcagtaagagaaatccactcttgctgcttttttatcaccaaaaatggaggagcacatggcaaatataaaagagattgcgaaactggcgaatgtgtcggtggctaccgtatcacgcgtattaaaccgacacccgtacgtatctgaggagaaaaggcgtcttgtgaatcaagtgatgaaggagatggattatacccctaatcgaaccgccattgatctgattcgaggaaagaccaatacaatcggcgtgattttgccgtacagcgaccatccctgctttgacaaaattgtaaacggtatcacgaaggaagcgtttgcccatgattacgtgacaacccttctccccaccaactatgaccccgctatagagatgacctatttcgaactgctgaaaatgaaaaagattgacggactgattgtcacgtcccgcgcgaatgaatgggaaaccgctgtgccttatctggagtacggtcccattgtcgcttgtgaatatacgcagcatcaagagattccctgcgcttataatgacaggcaggcagcttacagagaaagctttttgtatttgaaaaaccgcgggcatcaagatgttgcttttacatgtgtgcgggaagcggaaaaaagcccgagtacggccgacaaggtaaccgcatataaggcggttttcggctctcttgatgaaacccgcattctgatcggatgccatgatatggacgacggaaagcgggcaggtgaacacttctggggtttccacaaggcgccgacggccatctatgcgcacagtgatgatgtggctgccggcttgtaccagtttgcgaaagaacagaaatgggacgcggagatcatcggcgagggaaacctgagcgtcagccgggcattgaatatcccatctctggaacttcatttggaacgggtcggaagggaagcatttttgctgtttttgcacggagaaacggctaaaaaacaaattatgcatcaatttcagcggaaaaagtcttgagctgaaatgggtttcatgctttataactagattgagaaaaaaaaaggaggcggacatatgcgaattgaacatgcggccatatgggtgaaagatttagaacggatgaaagaattttatgagaaatacttcggcgccaaggccaatgacctttatcataatgagaaaaaagatttcaaatcgtattttctttcgtttgactccggatgcaggctggaacttatgaaaaaaggcggcattgatgaagctccgtcacagaatatgaccggatgggcgcatctcgcattttctacaggcagcaaggagcgggtgaatgaattgacggagacgtttaaaaatgacggatttcaggttgtaagcggcccgcgcgtgacgggtgacggatattatgagagcgtgatagaggatggggaaggcaatttgatagaaatcacagtgtaacagtgcgggggaacccgcactgttttattgattaaatttgctgagcattagttttcggaccgaatagaattaacaaaacggaacatagaagccagcagccgccgatgaacaaaaagacgctgatgtagccgagcttaacggcaataaatccgacgagcagggatccgaatatattggaaaaacggccgagcccgtatgccagcccgctcccggccgagcgatattccgtaggatacggctccgatgtatatgcgtataagtttgaggtgaaaacccgttccgtgacattgacgacaaatccaaacacaataatcatgacgggaataaacgtcatgccgtataacagtccggcaatggcagtcagaaaagcgcttgcggccagaatccattttctttggaacgtctcggatatcatggaaccgagcaatgcgccaagcggtgcgccgacagagtgaagcacattgtaccacagcgttttttccatggtgatgccgttgcttttcagcaggctgggcacccatgaagcaaagccgtaaaagccaaaggtttcaagaatccataccgctgacaggatgatggtgatctttaaattcctgccctgaaacagccctaagtagcctgcgtgcttcactgtatgtacttctgccgcctcttttggcgcgggaagcgggcctttttctttctctatacgtgcttcaagacggttcataatggcgtttgcctgatcatatgcgccccgattttcgtgccagcgcggcgattcctcaagccggcggataaaaaagaaataaatgagaccggccgccccccatacgaatacgagccgccacccccatgagcctaaaggaatgacaaaagcggaaacaacgtttgtgacgggaacgccgatcagtccgatcatggcgcaaaaggagatgtattttcctcgtacggatgatggaaaaaattccgccaaatagctgttcgtcacaatcatggcggccgcgacgccgagcccggtcaagaagcggaaaatcattaaggacggaatgtcccatgccagcgcattcagaaaagatgagatcgaaaagacaaggacaaaacaattcagcgcttttttcctgccgatccgatcggacagtcttccgccgatggaggcgcctaaaaacatgcccaggaaggatgcggctgtgacgtcggcaatgacggacagcttcacgccccaatgctcaatcagcgccggagccacgttgctgagcgtaaacagatcagcgagatcgaaaaaatagatgattccgagagcggttaatacttgatagtgcacacgcgaaatggggagacggtctaatcggttcgctacatttgagaatgtctgatgtttcataaaaaaccccctgacttagcaattgtaatcagaaaatactgtaaatttatctgacgaatacattataaaggtctttttttggcaaaaacagagtgtaaataaccagagccaaaggaaacggcatagcgctttcttcttaaaatatataacatttcctatatctgtttctgtttatattgtaaaatgttgaaggaaaggaagttgatgcataaatatgaatacatttgtacggcccgcagagggaagaaatagtgtatcgagatatcttctttctctgttgctcattgtgggtttgttctttttcggaagcatactgaccgtgttttatatgtttctcacgtccgctttcaatccttcactgacgataaattgggatgaggcggcattaagtgacccgctggcggatatttatttacagcatatcgtctatttcatagcgattccgggcatttggatagcggttcgtttcattatgaagcggcggtttttatccatcattacaccgaatcagtcgctgaactggaagagaattttctttggattcggcacatatgttgtgctgatgtttgtcgcggggctgattgattttttaattcatccggatcgtttcacgcttcaggaattccatgcttcacgttttctgctgctgttagcggcggccgtcttgttggtgccgattcaaacctctgcggaggaatttctctttcgcggttttctgcttcagtttgccggaaaattgacggcaaacgcggtggttctgacggtcattatcggcggattattcggcgcacttcatttcggaaatccggagatggaaaatggagctctctgggcgggaatcggatatgttaccatcggcatgatctggacctttatcacgattaaaacgggcagtctggagatgtcccttggcggtcacgctgccaataatatgtttttatttatctttctcacagaggatcattcggtatacggcggcattccgtcgatatttacaacagcagccggcggctatgaaatatacgattgcatatcgactctggtgatcaacatcatcttcgcatggctcgcattccgttttgtgaaaaaagaaaagcagcaggccgcctaggctctgctgctgatttgtaaggtgttcatcgcttcatcaatatccgtcgtcggcctccggcaggcgaaattctcacaaatgtagaccgttgtcttcccatcgatcatttgataacccgcggcaaagtcagaaatgccggcaagctcatccggatgttctgcggcgagaatcgtataggcgggagtgaaatgctcctgaagcgcctcaatgaaacgttttctgtccgggtcatctttccttccgaacacaacgatttctttttggggcattgtgtgtgccagtacgctttgcatgaagaaagcgctgctgctcggataggcctctatttcccgtttgaacacggaaaacatcgcttcggctttttcaatcagtgatacatcacccgtcaggcggccgagacgaagcaactgtacggcagccgcgctgtttccggaaggcacggctccgtcataaacctctttttccctgacaagaagagtctcggcatcattccccgtaaagaaaaaacctccgtgccgttcatcccagaacagctccagcatgcttgtacataacgttttcgctttctgcagataagacggatgaaaacccgcttcatacaattcaaggtaagcccagatgagaaaagcgtaatcatcgataaaccctttgtttttcacttcgccctcgcggtatcggaccatgacgcgcccgtccggcatgaggtgacgttcgagaaagcggatcgctgtttccgccatgctgagaaagtcaggctcgtgaaatacctttgcggcttttgccagcccggcaatcatgagcgcgttccatgaggtcagcactttgtcatctgtatgcggatagcttctgttttcacgcgcttccagcaattttgttcttgcctcttcaaggcgttcggccagctcatgtccggtgaggccggtctcttcgaggatggcctcacgccgcgtgaaaatgaggtgcgggatgttttcgccttcaaaattgccttgatctgtgatgttatacaccttgcaataaagcgggccgagttcatcaccgagaagattcatgatttcttttttggaccatatgtaatatttcccctcacggccttcggtatcagcatctaaagctgagaaaaagctgccgtcttcatgcatcatttcccgctgaataaacgttacgatctgcatcgcaatctgtttgtagcgctcattacccgtgacttgataggcttccgtataggcggtcaggagaagggcgttgtcatacagcattttctcaaaatgcggcacgagccattcattatcagtcgagtagcgggcgaatccgaacccgatgtgatcaaaaattccgccgttcgccatgccgtcgagtgtcttggttacgccggccaaagcctgttccttgcccgtatagctgtagtagcgaagcagaaacatgagcatatgcggcatcggaaatttcggagcctggccgaacccgccgtacaccgtgtcaaacccgccggccagctggcgatacgtgtcatgaaccgcctgttcgccaagcatgccctcagccgggtgaatcttgacttcaagatgagcggcggcgttttcggcgatatcctcgacatgctgccggtcattcgcaaacgtttcggacagatgttcaagcacatcaataaagcccggacggttaaatttgctcgtcttcggaaaatacgtccccgcataaaacggcttctgatctggtgtgacgaacacgttcagcggccacccgccctgccccgtcatcagctggcagattctcatatacacggaatccacatcaggccgctcttcacgatcaaccttgatggctatgaatttatcgtttaacataccggcgatctcttcgtcctcaaaggactcgtgagccattacatggcaccaatgacaagtcgaatagccgatgctgacaagaaccggcttgttttcgcgttttgctttttcgaaggcttcttctccccaagggtgccagtttacggggttgtgggcgtgttgaagtaaatatggagatttctcagcgattaatctattgggtgtactgttatttggcattggatcaccttctttcacttttaaattggttgctatttttactttaccataatggagtttagtttataccttattagattaactagattagattttatctactcgtctaaggaacaccagtcattttgcgcacaatttttttgcaaaataaagacttataaacatttgctgtttcttgtaaagtggtaactaataaagaaataatgaaacaaacgatagaggtttagtacaaatttataagacgttgattatttatacaggaggagagaattaacaatggcatatttatatttattgctcgcaatttttggtgaacttattggttcctctatgctcaaggccgcagaaggcttcacgaaactttaccctactattggtgcaattattgcttttataggttcctttttcttcttatcacttgcaatgaagtccatacctttgaataccgcctatgcagtttggtctggtgtagggactattgctactacaataatttcgattttgatttggaaagaaaaaattaacattgccagtgttactgggattgttttgatacttgtaggagttgtaatattaaatctttttggacctggtcatggtgaagcacatagtgttgaaaacgcaagcgcaacaacaaacaatgaaaaaataattgagtagtgaactgtttgatagtgaagtctataaaacctcacttttttatttatagtcatataatatttgaatgtcatcatctttcatgaaaagtaaagtctcttcgtttttaagttgttcaattgcttcattgactgtttgatccaatttagatttgggtctgtccttttcttctctaccgaccaaaaaatcagtggatacatcatataaatcagcgagtttctttaatgtctccggatcgggcgatctataatccctttcgtaattagacaatgtctaccctgttaatccaattttctctgctggcacgtcttgattagagtaaccggatttttttcgagcccattttaatctttggcctaatgtcatttgttatcatccattccacaaagagttgattaattattataatatcagcaattgctgaccctttcataaagtagaacaaaaaggcgaacattaacctttgactctccgaatcggagggttaaacttaatctgtagttttattcattttgttgtctcgtccatactttcgtaaaaattctccgaaggcatcttgaagcacaaaaaagctctgactaattaatttagtcagagcttttttttatgaagtattcccgagtatctgtccttgtttttttaggcaatactacgtccaattctttatttaaccatgcgagcgttttattacgaagataattacgcatctgttcttctgcttcaagcattaccaagttaattgtacaagaagaattgctggattcacaagagttgcatttgtctcgataaagtagaccattgcttacaatatttttacattggaaaatgggttttggtccttcaacagcctctattacatcccaaaaggaaatatcctccggggattttgctaacctatatcctccctttacaccagggacagaatttacaataccagctttagataatttaccgaaaacttttgaaagaaatgtttctgaaagtccttggaactctgcaaggtcccgaatcccgacactttccttggagggaacatctattaaataaaccagacaatgtaaagcatattcaaccccaacactgtactgcatataaactcacctgcttttgattttaaggtttatcacattgtatcttaggagtatttttgatgatagtcaatcttaaaacccttcttcagatactatttgttccgtttgacaaaataaaatacaaggtttatattagtgaccaagttaatcgtcgattaatatagtctttaatataaaatgaaaggagagtttcaaatgagcaaaacacttatcattaacgcacatccaaaagtagatgatacgtcatcatacagtctacgggtaatgaaccactttttagaggcttacaaagaattaattccagagagtgaagagcttgagcaaattaacttatatagtgatgatgtgcctatgattgataaaacagttttaagtgcatgggataaggcagaaaaatgcgaagaactgacaagcgatgaacaaaaagtaacaggacgcatgacagaagtattgaaacaattcaaaagtgcaaaaacgtatgtcattgttttgcctttgcataatttcaatattccatcaaaattaaaagactatatggacaatattatgatcgcacgtgaaacatttagatatactgacactgggtcagtaggtctgcttaaagatggacgaagaatgcttgtcatacaagctagcggatcaatttatacaaatgatgactggtatgaagaagttgaatactcaaataaatatctgaaatcaatgttcaatttcctcggtattgaggattatcaaattatccgagtgcaaggaacagctttactgagtccggaggatgttttacaaaaagcaaataaagaagttgaagaagctgcttcaagattggcaggtaaataaggtatagcatgaagatcattgttgctggggggactgcagtaattggtcggtcccttcttcctaaattaatacaaaacggccatcaagtatttgcattgacccgaggtaaccggtcgaacacgttcctcaaaagaataggggtaactcctgtaaaagcagatgcaatggatcgagatgctgttcttaatgcttttaggaaaatttaacctgaggttgttgtccatcagtttacctctttaacaggttacaatcttgaagaaaaagcgagaatcagaattataggtgcgcgaaatactgttgatgcgtgtcatgaaattggagtgaagaggataattgctcaaagtctttcttttgcttatgaacccggattaatacctgccaatgaagacgtccctttagatctcgacgcaccaaatccaaggaaaataaatgtaattggagtggcatcattagaatcagcagttgctgaattacccgatttagtaaacaacattaaaacattgcaagaaaatgggttgaacaatatctcatttgaagtaaatcatgacacgttagagcatctttccagcgtgtttttttatttgtgaaaatgaaaaacctgtcaagaaacaaaagacatacaataatcgcaataaaaacgaaaagaataatttaatcaatagacactttgtacctttttacattttaactttgtcaataaatgttcaatctgccatgtaaattttcaaaattctttacgggagtgggggaatttgcttgcaacaagttttcttgaacaaaggtaacgcccacaaccccgtaaactggcacccttggggagaagaagccttcgaaacccaagtattaaaaaggagaactgcttatgactctattttcagggttaaatgtcatctgctttattgctttttagataagaaataaggatttaaaatctttatctttttatttactgttagataggtgaaacacaccccggcgactgtaaccatcccgcctgtcagtgcaataaacgcaggtacttcacctaaccacacccaagaaatagccaaggctacggctggtgttaaataaagtgaaatggctgcttctgaagcaccgacgagtgaagtgacatacgcaagtgcaaagtaaggcacaaccgttggtaataagcctaagtaaacgacagaccatgtggaattcatcgatgcgtgaacaacttctccccataaccccggaagaaataccagcattggcaatgtcccgccccaaatagtgaatgtaacgaatgggataaatccatatttttttatatagcgggcttgaaaaacgaaataaatactctccgaaaaagctgccagcaagattaacaaaatgccgttcactgaatttgtatagtttcctgccccaaatgaaatgatcgatacacccaataaactaatgatagagccgacccatttataaaaaccgaaatgttcaccaaaaaacagacgggataacattgcagaaaaaataggtgtcatggtcacgagtaagcttgctacccctgcgctgacgtttttttctccgatattcagcaaaatgtgatatagtgcaaaacctaaaaatcctaacgataaaatagcagggatatccttcatgtcaggcaaacgcatatgagtcaaaacagcaaaaaccaccaatgccattgacccaatcaacaagcgaaacaaagcgaggtgttccggcgtgtaactctccaaactcgcgcgaattcccgggaaagctgatgcccacaacccaatcatcagactgtaagctatgccgattcgaactgttttctttctcatctttctcactcctctttacaaaaaccaaccagttatttaatgtttttctatattaataaagatttgatgagatgacttcaaccagttaaatagattttgacccaaccactttaaggaggacccttttaatgagcgctccagaagaaaaaaagatgagaaagcttcctaagtacatacaaatcattcaatttataaaagagaaaataggaaatggagaatggccgatcggaagtaagattccaagccagcgcacgcttgccaaacactttgaggtgaacaggagcacagtcattacagctttagaggaattgacggcggatggattaatcgaaggcagaatgggcaaagggacagttgttacgaacaatacatggacacttttggctaagaattccgctcccgattgggatcagtatgtaacctccggaattcagcagccaagccaaaaaatcgttcaagagatcaataaatcagaatcaaattctgatcttatacagctcagtaaaggagaactttcacatgagatttttcctttagctgttatgaaagagatcatgggaaaggtatcccaaaacatagaggcattcggatatgaggaaccaaaaggatatttgcctttgagagaggcattaagcggctatttaagaacaatcggcattcaagcttctccttcttccattcttattgtttcgggcgcactgcaagccttacagcttatatcaatggggcttttacaaaggggatcgaccgtttatcttgatcagccttcctatctttattcattacacgtatttcaatcagccggtatgaagctgactggagttcctatggatcatgatggacttttgccggaacatatccgcatggcaaggggagaacgggggagggctatcttatatacaaatccttgttttcataatccgacaggtattttaatgtcaaaaaagagacgagaagaaatccttgcggcaagtgagaatacacagcttcccattattgaagatgacatttatcgtgagttatggatagatgagattcccccggatcctattaaaacaatagataaaaatgggcatgtgctttacataggcagtttatcgaaaacattaagtccgggcttgaggattggctggattgtcgggccggaaccagtgattgaacgtttatccgacataaaaatgcaaacagattacggctccagttcgttatcccagagagtagcggcagagtggtttatatccggtgaataccagcagcatctagaacaggtgagaagtcaattaaaggtgagaagagaattggccttgagtgttttagaaactcatttgaaagatgtggcgacatggaatatcccaaagggaggattctttgtctgggtaaaaatattgccttccatatccgtgaaattactttataccaaagccttatcaaaagggattctgctcaatctcggcaggatctatgctgaggaaaaagggagttatattcgcttatcatatgcttatgcatctcttgaagaccttcaaaagggaatttatgaattgggtttgatgattaaggaattggcaagcagataaatttatcataattactttaatagaaagagacatgacaccaatgacacgcggattgttcgctgactacggttggggtgctggttaaaaaatacttaggagaacttgatattcaaagagctgtaagagagagattatctttaaaaccgtcactagcagaagtcttcaaaattatttaagttaatataccggtctttattgagatttgttttaaatatgcatttgaaggtcaattttatgatgactaagaactaagaattacactactttataaccgtaatttattaatgaaatatttcctgaaaaactttgatttttaattgcagattgatataataggtttgttattcttggccaaggatgagaatatttacaaatcttcaaaaagtggtgttagcaattaaaaaacctcatattttattatttatattaatttttacattaggtttttttgcgtgctttttattcatttttaagcatatagagagaaatgaaacagaaaaaattaatcataaccgtgtacaagaagtaccatggggagtgaaaaaaatcaatgctgcttcaatatggactttaagagagaaacagaaagtgaaagttgctatattagacagtggtattgataaagagcataaagatttaaaagggaaaattaaaggggaatttaatccaataaacatgactttaacctcagatgatgatgtggggcatggaactgctattgcaggcattatagcagctaaagataatagctttggattagttggaattgctccagacactgagatatattcagttaaagtactaaattcagaaggaaaaggttcgctagatacccttgttaaaggtatagagtggtgtattgataataatattcaggtaataaatttgagttttggattaaccaaagataaaccgttgttaagaggtgcaattgataaagcagtaaacagtgggatcataatcgttgcagccgcaggtaacaattatggcggggatgttgattatccagcagcttatgaaaaagttctctctattaatgctgtagatagaaataataaactagctaacttttcacctaaaggaaagattgacttttctgcacctggtgtagatataccgatactatccctcaataatggatataaaactgaaagtggtacatctttagcagctgcacatgttaccggagtaatatcattaattttacaaaatagagataaattcggaattgattcaaaagaggatatttataatcaagttaaccgtgtattgtccaaattgtccatcgatcttggaaagaaagggagagatgaaatttatggaaaaggatttttatcttttaagtaaaggggctaatttcaatgaaatgttttaaaaagagtattgctgtttttttaagtctaatattaacttttacttttattttacataatgaatcaaaagctgaggctataaacaataggtattaccaaattgtaacaaatgatgaagagaaattagtaatcacagcagaaaaaggcggagttaaaggtttaatgactttagataaagaaaatatgaaactttcattaataaccgatgaaacttctcagaagactggagaaaaaggtaaagaatataaagttgatattgaaaatgctacaaatgagaagatagaagcaacttttactgatacggaaacaaataaaaagtatgagattaattcagatgaggtaacagcttcttttgtttggtttatacctataggaatagttattggagaggcacttttagcgcatttaatttcaattggattagctgtgactatttcaggagtgacttatgttgcctattctgagtttaagaagcgtaaaagaacctattctcattatatggcagtaagaaagtctaaaggattatttatcggtaatggtttgaaaagacctgctgcaattgcacgccttaaaaggggtgatgacacttggtctacgtcgaagaacaatgccaaatctattgctaaagccgcaagtccgattaaaaaaattgttggtccggagatagataaaaagggtaaaggtaaacattatcattatcactcgatctctaggtataaacatggaaaaggtgtccgtatgaaagctcatgctttctatggggcagcaagataatttagattaatttataaacacctaactttaaagtaattaaaagataggaaattataataggagaaggaggtaactatgttaattattgatcacaacccaaaggatcagctgtattcagagttaattgatttggctttcgagatttgcgacgaatttcatttagttttaagaaaagatatgggatctttaaaatcattcgatcctctgttaaaaaaacttgaaagttcgttaaaagtaatgaaagagcaatcagaatgggccagtaccattctaggagacaatcaaaaagcaaaagtttattactattatacagatgaaaacgcaaaaaacattctgaaagaatccgcaaattctttatattcttgggagcagccacatttaccagaagacttgtctttttttaaagatggaaaggagtggttggtaacatgctctcatgaagaagaaagttatatcgatactgaagatgataaagaaatacaaagaatattgagtataccaggattaaaagtgcattttgaaagatgggattaaaatcattcaattttttataaaaaaattgaatgattttagtgaataatatatataagtaaggaaaccgtatagaatggtttccttacttattaaaccaacattactcaattgggatttttcttgtttatttcttgactaatacatattgtttatcttccaaatagaatatatgactaaggtgatttatatctttaaactttatatgttttccaaattgtaaagtatttaaattgataactacacccatgctttcatctttatcttcatcttcatatccatctaagcaggaatatatttcaattgattcaccttttgacaagtgtttttcaatgaaaagaaaaagtgatttaatagatttacgttggccaggtgtattgttggcatgtaagtacccttgtaattcatatatataaggatgtgtgaatttgtttctgactgcttcatatccaggatctaaatgaacaatatcaattccgtatgcatcttcttctgtgtcataaacctttacaagtgaattttcactgttctttcgattgtttttaaattgagagcgtttgttgacatctccttttatttttagttcagaaatgggcttaagtgtaggattactgccatactcaccaataggaagttctttatccgccccaataaaatgatgtaaagtcaatctatttcctcctttatcttatacaactaaaaatactcaatctgactttggataatgagatcttttttgtgtgtctatgataccccgtgtttcttgcctcatcaaggcttgataatgtttgaaggctgaagatggatgatgtgactgatttttaggctccttagggaaagaggaaccgaattaatttaatttaattgttatattgttgacgcatactccatcaatgtccatttagatggtatttttacagctgcagatttttcttcgactatttctaatgttctttcaagttgattatatatgtatccggaaaattaagtataccgtttgaccaatttcagcgttatgaagatttcgttgccagaataccaacaattgaagataaattgaagcagaatagtattaattctaaaaagtgcgggcgcattatggggagaggggaatcttacacacttatctgcagcttcacccacatactttgtgaaagctccaacagcttcttcgcattctgcaagacaacaactattccgttgctttttaacattttcacattacaggattcaggataaaaaagccgccaacagggcggcttttcttaagttaatataccaaatatatatcaaacttcaatctgtatagctatgtctttcctaaaaaaccatcggcttggttcttgaagagtaaatcatttaacccaaagcactattactcctgcagatgaaatttagattattgggctgtatagccgccatccattacgacggcctgccctgtaactccattagctttgtcactggcgaggaatactgcgtaatcagcgatttcttgcacggctaacaaacgtttttgaggaaccaaggggtaaatgacttcttcaaacaccttttctatagaaatgcctctagtctctgcaatatcttgtaactggttttgtaccaatggagtgtcgatatatcccggacacaaggcattgacagtaattccgtattccgctccttctaatgctgatactttagttaaaccgatcaaaccgtgtttagcgctgcaataagctgctttccctgcaaaaccaattaaaccatttatggaagccatattgatgatgcggccaaatttttgttttttcatcaaagggaacgctctttttgtcgcactaaaaggagcagtaatcattaatttcagcataaattcaaatttatcagtcgggaagttttctatatcagacacatgctgaatccccgcattgtttaccagaatatccattcgcccaaaggtttcaagtgtcttagagaaacttttttcaacttgttcttcgtttgttacatcacaaaccgcaggcaggacttcatatccttgtcccttaagttcctcagctgcatgatgcacggctttttcgttcaaatcggaaattaccacttttgcgccttctttagcgaattcacgtgcaatttctaaaccaattccgctagccgcgcctgtcacaagagcaactttactttctaataatttactcatagtaacccctccaggaaacattttggtctcctaaaagtttacacccggcagttgtataagtaaaatgaataaaaagaatataatgtattcgttaaactcatgaaatggagatcatacgatggatatacgccaaatcacatactttcttgaagttgctaaatccaacagttttactaaggcatcagaaaatctgcatttgtcacagcctgccttaagtaagatggttaaaagtttggaagaggaattaaaggttgatctcattgatcgatccgctagacaaatcgctttgacagatgcgggcgaaattgtatttgagcaaggccaaatgattatgaagtcattagatgacttgtcgacgaacttatacgatcttttgcatttaaaaaaaggaaaagtgaaaattggaataccgccgctgatcggtgtcttgttttttcctaaaatcattagagggtttaaacaattgtatcctgatgtgaacatcaagctgatagaacatggaggaaacaaggtgaaaaaggaggttgaagatggagtactggatcttggcgtggttattgaaccagtggacaaagagcagtttgatatcattccattgcttaatgaagaactgatgctcttcgttcattccgctcacccgcttgttcataaagagattgtggaaatgcaagacttgaaaaatgaacctttcatcctgtttagtgaagacttttctcttcacgatcggattattcaggagtgtattagagccggttttcgtccaaatattgtttatgaaagttctcaatgggattttatcagcgaaatgattggagaagaactaggtatttccattttccctcagtcgatagtgaaaaagactgatcaaagtttagttaaggcaatctccattgtcaatccatccattccttggaaagtggcgattattttaaaaaaaggaaaatacgtttcacacgcagtacgcgaatttatccggtatatttcatctttttgtaagagtaattacgtagactaagatcactcatgaaaaaaatgaatggtttttatagtttttatgtattttacggttagagagggctgcgatatattatcttatgtcaggaaataagtacctttcaggaggaatttcaaatggatcaaagccgttaccagcaaggtttagacaaattaatggagtacactttaacaaacgatgataaaatttctacgcatttaaagatttctgaagacttgaaagatatcgctccagatgtaagtaagtacattatagaatttgcttacggagatatatattcacgaccgggattaaccaatcaacaacgtgcgcttgttaccatttcatcccttgtaacgcaaggaaccgagccgcagcttgaacttcatatcaatacagggcttacatccggattaacaccgactgagattgtagagagtatcacccaattggttccttatacaggcttcccgcgtgtacttaatgctctttcagtagctaagaaggtgtttgcacagcggcatgtagaaagccattgagaaataaagagcttgtatggaatgcgggatgaagtagtataaactcatcaatagaatatacacaaaacgacagcctataaggctgtttttaacacaaatgtctgacctcttttttgttttcggctgatcatatgtaaaagcgattatatgaatcgctttttgatacttagaaacatgctaaccttcgacctctttatcagtaagcacttttaaagcatttcttacttttaaggcgaagttgacaggtttatcaatcgcttcgaaatgaatatacatcagtctcggtttgtcaaacagccagtgattgtgtagagacgttacaatcagatcatgtttccgaagagcgctgataaatggattgatttctttttgcagaattacagtttctccgctgcaaagagcacggccgtcttttgtcattgattcaaatgaaaacatttgcggaatgagcaaaaatgatcttccgggccgtcccagtacaaccggttttatattcgttcgtgatctcattactgtacaaattccattttcaaacgtatgcatggttccgcccagaatatcgttgaattcgtcacaaagaccatgccgttcaatcatttccccgtcagtttttggtaccgcacgcacagttttagtagtcagaactcttagggcctctcttacttttcttgcaaaattgagaggtttgtcaattgattcaaaatgcataaacatcagacgcggtttatcaaacagccaatggttatgaacggcagttacgatgataccgaatttgcgcagttcactcattaatgggttcacttcttcttgcagtaaaacagtctcacctaaacataaggctctgccttccgagtccatgctctcaaatgaaaaggcctgaggaataaaaggaaatgcctcggctcttcttccgagtaccaccgggtgaatgttgcttcgaaatcttgtcgccgtacatacgccatttacgacactgggcgttgaattgagaattcttgcaaattctttgcagagtcgtgatggctccatactcgtttcttccacttcatatctcctcctgaaatcaatttaaacgtacttaatagtaaagatatgtgaagatagaaaaaatgtaacgcggcaggagtccataatagagagaatcagcttttttcaccatctcttcaactgttaattattaatagattttaatcggactatttaagatgtgataaaagccttccggatgtgtttgtccattcagtttacattgggtgatgcctttttcttttaccatgttttctcattcgcttatgattactttgcccaacccgtatttgcggtaaggcttcaggatgcagattcgttcgagcttgcctgtttggtttacgatgcggatccgtcctgtgccggcaggctgattctcatgataaaccaagacatgcccgcactgttccccaagcgtatcgaactgatcaaattcatcggattcaggtacttgctgttcctcaatgaatactgcttttctaatctcaagcgctgcttgtaaatcaatttctgttgtatcctcatgatcaaccaacccttttcacatattagtctggactgcacggcttgcttgtggtcttatagaagtaacgacgaaacatttatattgcaagtgcaacaaaaatatgaagggtttgaaaagatatgactgatattttgcgtgaaatcggcatgatcgcacgggcattggattccatcagcaatattgaatttaaagaattagacttaacaaaagggcagtatctctatcttgtgcgtatatgtgaaaacccgggagtgatacaggaaaaactggcggaaatgattaaagttgaccgaacaacagcggcgagagcgatcaaaaaactggaaatacaaggatttgttgaaaagcgtcctgatgatcaaaataaaaaaataaaaaaactgttcccgaccgaaaaagggagaaaggtttatccgttattgcaaagagaaggagagcactctgcggaagtagcactgtccggctttacgtctgaggaaaaagaaaccattttcagccttcttcagcgggtgagaaaaaatatagagcatgattgggaatatgtgaagaagggaaacaaaagagactattaatggatgataattccttttactgaatgattgcgttgtgaatgattaaagtcataaatggatacgttatctgtgaaatctccttcctcggttcctgcttcaactagccgataggcttatttttaacgaaaagtatcaattatggtatatttaaataagacaaaataattgaagcggggaatgatatgagtacaatcgaaaaacaaagacgtaagaaattcagagccaaatcaatcgtacgggtcatcatggtcatcatcggcggaattattgccgcgtatggactggaaaccgtactgattccgaatagtgtatctgacggcggtgtaaccgggctcagcattgtcggttcacagctgtttcatttgcctcttgggatcttgattgcggtgatcaatataccgtttgtctggttaggatataagcaaatcgggaaaggttttgcgtttctatcaattatcggtattgtctcacttgccgcgggcacgagttttttccaccacacgccggctatcattgagggagataccctgttaatcaccgttgtcggcgggattattctcggcttgggaatgggattggcattgcgcaacggcggcgccttagatggaattgatatgctggctgtgcttctgtcacggaaattgccgtttggcacgagcgatctcattttatttttaaacatttttgtgtttatttttgtttcttttgtattcgggctgcaaggcgcattgctttccgtcattgcttactacatcgcatccaaggtgatccatgtggttgaggaaggcttaagcggttctaaaacatttcagattatcaccaacgagcctgcattaatggtagagaccattcgtgaagaattgggccggagcgctacgtataaagaagcatacggcggtttttctcatgaaaaattcaaagaaatcacatgtgtcatcaaccgtttggaagaaaccaaactgaaggaaattattaatgacattgataatcaagcctttgtgacggtatatgatgtcgctgaagtaaaaggcagtaatttcagaaaaatccataatcattaagaaggagctgccgttcaccggcagctttttttaaaaaggagaaaacacttgcaaaaaaagaataacggatgtatattattgatatatcaaacattgactagtcaattaattgcgcaaaagaaagtagggatgggttttgacagcatgttgttcagaggaaggcgagattttgtatcagctccaatcactgcacaaagtgatcggcacgaagtttgaagcgtgcaccggaatcagccaatcccgccttgagcttctcgccgtgcttttttacgtcgatgagatcagccaaagcgatcttcagaaaaaggtgaatattgacggcgcagctgtgacaagacacttgaaacagcttgaagccaaagaaatggtcacaagaaggcggaagcctgaggacaaccgaattatacttgtccggcttactgatcaggggcgggagagaattgaggcttccaaaaaggagaaggagcgtttcataaaggaaatgcttgccggtgtcagcgaggaagaacgcagtatgttaaaaaacgtattgtcgcagatgcagaataatatagaaaatatgaaagcataggagtgtattacacatgaaaacagaactgaaaacaaacgattttatggacattatgaaaggccgccgttccattcggaattacgatccggctgtaaaaatcagcaaagaagaaatgactcaaatattggaagaagcaacgacagcgccgtcttcagttaacgcgcagccatggcgtttcctcgtcattgacagccctgaaggaaaagaaaaactcgcgccgcttgccagctttaaccaaacacaggtcagcacatcatctgcggtgatcgcggttttcgcagatatgaacagtgatgactatttagaagaaatttattcaaaagcggtcgagctgggctacatgccgcaggaagtaaaagacagacaaatcgctgcgttgacggcgcattttgaaaaactgccggagcaagtgaaccgtgaaacgattctgatcgacggaggtcttgtttccatgcagctgatgcttacggcacgcgcgcacggctatgatacaaacccgatcggcggctatgataaagaaaagattgccgaggttttcggaatggataaagagcgttatgtaccggtcatgctgttatcaatcggaaaagcggcagacgaaggatatgcttcctaccgtcttcctatcgaaacaatcgcacaatggaaataaggttgaagtgaagctgagaggagagggacagtggacataattgcggctgttttcgtcggaattgtagctttagaacatatatttatcatgatacttgaaatgttttttatcaattcgaaggctgccaagcggtctttcaaattgccgaagcatttagaaggcgatcggaatgtggcggtcatgtttgcaaatcaaggtctgtataatggatttctggctgccggcctcatttggggactgatcctcggagctgatccgattggccatatgattcaaatgtttttcgtcatctgtgtggtcatcgcggccattttcggaggctttacttcaaacaaatcaattatcgtaaaacaaggacttccggctgttttagcgcttatttttcttttattggcgtagcagacggagtgagtgagggcttccggaaaggaagccctctttttttattctgttttgaaaatcatttcttatatacatcactatagattggggatgtcaaatcagctgtcaccccttcttaattgttatttgctgaaagtcttctatctgctaataaagcctaatagatggagtggactccatgtcaatctgtttttttaaaaaaagctgatcggtaaatatggtatgatttacataatcagggagtggggttgcagaggatgaatatgaagagagcgtattacgctattttatacagccagaccgctatcaacttggggttttcactttatacgatggccgtcatcttgtttttgtttacaaaaaccggttcgacggcgatggcctctcttatgacgctcgtcagcattgtatgccgcgtattgggcagcgccgttttgccgctggtcaccggtcggttcacgcttcgttctttgttaatcagttctcaattgatacagatcacactgttagtctgtttgttttttgtcatccaaaccggttcatccgcattcttttttctgctgttttgtctgatcggaggcatttctttttgcaacggatggtttgctccgataaaaagcgcgctgattggggaaatcattcctcctgatcgaagggcgaaagcgaacagtttattatcggcggcggatcagaccgttcagtttgcggggtggtctctgggcggcgtcatcatagcgttcctgggagagagcgatacaatgatcgtcactgtcatgttattggtttcttcggtgttgggcatcattctgtttcttcaagtacgcatgtgtgcgccggcagcagtcagggaacgttccctttttgcagatgcggcaagcggctgggtgtatttatttcagcaaaaacagctcaaggttctcattgtgatggatgtgatcgaatcgtgggcaggcatgatatggatcgggtctgtgtccttaacttatgtgcatgacgtccttcataaaggagaggcttggtgggggtatgtcaacggagtctattatgcagggacgatgatcggcggactgatcatctataagttatccggtaagcttcagcatcatctcattccgcttatgctgacgggagccttggcatatggaatgttcacgtttatttacgggctgatcacaagcgccgttacggccctttttctggtgctgtgtatggggccggcttgtgtattacgagatctcacgcaggaaacattacttcaaaatatcacgaccgaaaagacacgggtcaatatattagcggcgagatcagctttagttcagttcatttttatgttttccattatcggaacggggattatctcggatgtattcggcgtgcggtttatttatattggcgcaggccttctcttattaatttcggcttttatcggattttctcagctgcgaatgaagaaaatggtacagagcggcatgtagtgtagtataattaggaacgtacgttctatatcgagagaggagagggtaatgtgggacatctggcactgcaattgtatgattatcatctttgggcaaatcagcaaatattcacccggcttaaagagcttccggaggatgtgtaccgtaaggagattcaaagtgtctttccgtcgatagccggtgtattgactcatgtgtatctgtcggataaggggtggtttgatgtgttctccggagagcgtctggaggatacgctgaaatcagctgaacagcaaaaagaggacatcttgtctaaagagatagaagagctggaagatctatttttgaaattatcagaccggtatcaactatttttgcagaaggaggaaaatatcagcctcccccttgaaatagagcatccgtcaggtgacatcatgaaaaccgcagcggccgatatgatcctccatgttgtgaaccacggaacgtatcatcgcgggaatataacagccatgctcagacagatggggtatgcttctgtgccgacggattacggtatttatttatatataaacaaaaagtaaacaagacaggcaacgcggctgtcttgtgatatccgtaaaaaagccaaatcatatgagtgatttggctttttcgtttgctatgccatgttttgcagccgttctaaactgtttttccaattcgcttcaagcgctgtaaaagcagcggcggcatcttgctgttctaatgcgtgaatgatatcagagtgttcattatatgatctgtttaaagcgccgttttcactgaaatagcggatttccagtctctgaattttgactttcaggcttactagcaatttgtgaagttcagcgttgtccgcaagcagaatgatgcgatggtgaaatgcattatccgcttccagaacggccattttatcgccgtctttcatcgtttgaagaagattttcattcagctgtttcaattcttgaatcacggcatcgtccatacgcgggagggcttgctgcaatgcgagtttctcaagcgtccagacgatggaatacaagttttccgcttcttttaactcaatcggagcgacaagtgtccatctgttcgcttttgttatcaccaagccgtcatcttccagccgcaataaggcttcccgtatcggggtgcggctgattcccaatgtttccgacaaatccttgtcctttaactttgtttccggtttgagcttgcccgttatgatccagtttctgagtgtgcgatacacttcgtcccgcatgatggttcttttcagcacaggttctttgttttgattatccaatggaacacctcatgaatcgtagtatacatatttgcattttaccacagtccgggcgccggttagaaatgaagagggacgtctaagaatgaatcgaaccgagatgcttcatctcaatatgctgaaagtcagcggagccgccttcagaaaagagcgtgattccctgatcttcgtgttttgggaacacttcatttgtcaaaacggtttttccgtcgtctgcaaatacttcaatacttgttttatccacgagaattttcagatgaacgcgccctttgtttccgtcaaatggggctttgctttcggtgtatgcaccggttttatcaggctggtctgtaaacgatctgttcacataggcacaaccgtcttctgctgaaataccgacatcaatatgccggctttggtctgctgattctctgagtctgacgcctgcatttttgatatctgaccaagcgatatccatatcaagctgatatgtatcacctttgatcggcagtgtctctgaaccgttcacctgtttgtgttctatgctgtcagttgaagaagttaattggttcaatgcttcaaccggctctgacacaaggctgtatgtgccgccgtcctgctgctgaagacggatttcacggacgatagaatccgtgccgttaaagccgttttttagtgtcggtgtttcattcggataatcccaattgttcatccatgccagcgcatagcgttttgtcagcggatcttcgctattaccgtcttcaaatgtgacgccgccgtaccagtcaaagccgtaatcaagccattgcggttcttcttgatcggcggtaaattccttcccgtcaaagtttccggtccaatacgcgtacgtattcggtttgcctgcgggtttgccgtttgcgcttgcgcccagaacccacttggctgtgccgtcatctgcacgcatcatataaaggtcggggcattcgatgaggccgatctgctgagtgataaaaccgcccgtgtatttccaattttttaaatcgggtgattcataaaaaccgattttttctccttcggccatggccatcacccatttgtcatcctgttcatcccagatcactttcgggtcccggaaatccttagttcccgggtttttcataacgggctgatcactataggaagtaaacgtttttcctttatccgtgctgtaccataaatattgttcctgggcttttgttttggctgtcggctgcgttgtgacggcgaccagcgcgtttttgccgaagcccgcggtgttgtgtttatcaatgacgacagaaccggaccagatatcgccgttttcgttggtgtatttcggaatagccgtgccttcgtccgtccagtgcaccaagtcctttgatacggcgtgccgccattctgtgccgttgccgttcgggtaatcccgattataaagatagtagtaatgatatttcccctcgaaaaaaataggcttttgagggtcgtttttccatttgtccggagtcgtaaaatgatacgccgcccggtaatccttcttatgctccgtgttgtttgtgtcagaggaattgtggtttttgttcggcagtaagccgacaaacaggaacgcacccaaaaagatcaatattacaacgggccattttcgtgccatgattgaattcaccatcttattgagaaataaaagaaaatgccaatgaagtatcggcattttctttttgttgttattagttgttaaccgtaagctgtccttgttcaaggatgctgtttttaacaacggatgttttcttgcctttgatgttcattaagaagcttggcgcaaatgtcgcctttttatcctcaaagaagcctctgtttgtcatgtagcttgtgatcacgacattgttgcctttggcttgcggcactgcgaagtgagagtaagtgaacgttacgtcgttaggatcaagacccatttgcaggacaagaccagttttgttcagcggcttgtaaggacctgttaaagagtttgatacataaccaagcatgtaaatatcgtttgagttaataccgtcgatcgtcatttttgaaccgcgtgaatcagtgaacaggtaccatttgccgttcattttgaaaacattcgcgcgctcgatttcatcagttaccgtgtttgaagtgatcagcggcttcatgacttttttcaatgtgtaatcatcgtttaactctaccataccgagggcgccgttcgctaattcagcatcgcgttttttagcgctttgctgaagcttctgactttctttacggaagaagtttgtgctgccgccgtagtacgctttgttaaataaagattcttcgccttggtatccgttttctgttcccgtgttggcttcgaatacaaggtatttatgtcctttgtcttcaacgtagtgagggtctctcagcgtatggttgtcgccggatgtatagttcccttcatcgataaactgctgaacgttttgatatgtttttccgtcgccgtcaaaaatcgttttatgatcttcaactccgttgatcttgagcgtgtcatcagattttgacacatttacctgcgccgttgtcaggctttgtttgccgtaatgtttaccggaaaagtcagtgtagaataaacggatttttccgtcagatgtaaaggttgcagaaccggaccattcttgtgtctgttctttcaggatttcatcgttggcgtcgaacttatcgctgtctttaaagacacggcccgcgtttttccagctgtcgatcgagttgtcgccgactttttgataaaacatgtagatggatgtgtcatcagcgtctttcgggcttccggcaagagcaaacacgacgtgatagccgttgtattcagctactgttccgtcagcgttttggagcggccagctgtcccacacatccagtcctttcgcggactcgatatttttaattgttgatgggtcgaattgaggcacttggtatttttcactttgctgctgtttagggatctgcagcatatcatggcgtgtgatatgagagacgccgtacgtttctttgtaaggtttttgggtattttctttcgcgaaggcttgagtcgctccccctgccagaagtgcagtcgtaaaagttagaactgtggctcgttttgcaaattttttgatgttcatgttcatgtctccttttgtatgtacctttttttgcgatctgccgattcgatcctcctgcattcatggatgacaggtttgttacagaaaaaaagacctaaaatatgtatggggtgacgccaaagaatacactttgcccttaacacattttaggtcttgcctgctttatcagtaacaatcctgcatgatttacttgtcgacatcattctattagactctgattctattgacaactggtctattttcctcttttggatgatagtaaaatgaaaaaaggccttttaatatatgggtaattgagcctaaggggtgctctggccctaggaaaaaacctctctaaaaaagagaggttattttttcttgatagataataaagcgatggtggttaaaatcagcaaagtacccagccattctgatattccgaagggaacatgcagccagataacagttaaaaaagctgccgacagcggctctgcacaggcgagcaggctggtttcagaggcactcagatatttcaggctttccaagtagcaataaaaagcgatgagcgttccgaaaatgatgataaacacaatcgcggcatatgcaggaaaggaccactcgccttcaaatgtccagggcgggcggatcaagctgagggcggctccgccgatcagcatgccccatcctacaacaatggcggatccccatttcttcagcagacgatgcggctgaagggtgtaaaacgccagtgcaaacgccgaactgattccccaaaagacggccagaccggatatggacaggcttccgacattcccgtgcgtgaccaaaatgaatgtgccggcaaccgccaataagacggcgagcagctcttttcctgaaggaattctctttgcgcgaatcgctaaaaagcatgtaatgatcgccggtcctaaatactgaagaacggtagctgttgccgcgttgccatgctcaattgccgcgaagtaggtgtattgaacacctaacattccgaaaatcccgaataaaagaaggggaattctgtcccgtctgtctttccaaacagcccatatccgtcctttttctttgcggtacgcgattccgagcagaagcgcccctgacaccagaaggcgcaccgaagtcagccattctgtattaaaatggcggtgctggaacagatactgggcaaccgttcccgagaccccccataagatagctcctgtaagcacaagccaaatgcctgttgttcgtgaataagaaagagcagcgtgtttttccaggatagacacccccgattctgatgttgcgacagcaacttacaataattagaaaaatgaacgccttacatgtgatatattatatattgtatattaataggcgtcaaaataattttagagtaagcgcttacgaaacggccgtctgatgaacgagctgtaaaaaaaacaccccggctggttgccggggtgttttggttattctgcaatcgcgtctgttaaaacaggaacgacttgtttctttctggatacgacgccttttaaaagggccgtgttgttttctaacgtcacgttgaatgctttttccacttttgacgcttgatcaccgatggcaagcgcaagggaatcattttccagaatatccgtaatcacgagaaggaacaggtcaaggttcttctcggcaattacttttgaaagagccgcttctaattccggctgccgctttttgacatcttcaatatcaactgtgttgacttgggcgatttcgacttttttgctgccgagcgtgaactctttcgcatcaagagaaatcagttcttccacagtttttttgcttaagtcggcgcccgctttcagcatgtttaagccgtactcttccgcatctacgccggcaatttcagcaagctcttttgccgctgcgatatcttgctccgtgcaagtcggagatttaaataacagagagtcggaaatgattgctgacagcatgaggcccgcaatttctttctcgattttcacgttattttctttgtacattttgtttaagatcgtagccgtacagccgaccggctcagcacggtagtaaagaggttccgctgtttcgaagttggcgatacggtggtggtcgatcacttcaagaacctgaacgtcttcgatatctttgatgctttgctggcgttcattgtggtcaacaaggatgacgccgtttacttcgtttgcggctgtttccaccaaacgcgggctttcctgcttgaaataatcaagcgcgtattgtgtttcgccgttgacttgtccaaggcggacgggctcagcattgaagccgagtttattttttagatcagcgtaggcaatggcagagcaaatggtatctgtgtctgggttttgatgtccgaaaataagaattttttccataataactccttgtccttttttgtagtgtaaacaatctttttatagtttaacacgtcttgcggagggtgtaatcttcaaaaccttaaaaattgatgtgaaaaagaagcatttttgttgagcggtgaggaggattgcgagtaaaatactgggtaagtcagatgctaatcagcatatagtatcaaaaaaggtactatggaggatgaaaaatgaacatatatccgaataaagaaggttgtccggttgaactgacgctttccgttatcggcggaaagtggaagggtattttgttttatcatatgatcggcggaaaaaagcggtttaatgagtttcggcgcatttgccccagcattacgcagcgtatgctgacgcttcagcttcgcgagcttgaggcggacggcatcgtgcatcgcgaggtatatcagcaggtgcctccaaaggtggagtattctcttaccgaattcggcaggtcgctggaaccgatcgttttgcaaatgaagaaatggggagatgccaaccgggagtttctcgagacataccgggaaaaaacgtcgcctcaagatcagtccgctcaaaaataagaagcagcaaaggattaaattccttgctgcttttttttatttcatcgcgatggcttttctggcgttgcgcacatcattcttcagcaattcgctcaggttgtaagccggatattgaccgcgttcttccatatactcaaagaccatttgatgccacttgatggccgcgtttaagtgcttgacgaaaacgtgtctcaattggggtgtggccgtctctgtaatggctccggcgtaattgcgcacagacgttttggccatgctcagcagaccgccgctgtaaaacgcggaatcagcgcgctcttctgtttcatcctcacgaaaagcgggagcttcagggaagaaaggaagcagttcacgcagattttgttccagcgaatggatggaaaatcggtaaagctgttttaatctggcatcgcttacgtcccgctctgttctttttaatttcacaagtccgtttgcctggaaagccactaactcatgcagttctaacgtttcatgccatgctaatgttctccgctcggtcatagtgtaagaatctcctttatccttcattttcactttcagcatatgccccggtcccgatgttgttcctgatgttttgaagtttccagaaagggaaactcaatgtaaaggaaatacgaaatagaggtgaaactatatgtgggacatgataaagaacttcttccttttcagcagcggggttttacaggcgaccactctcttacttatcgttatcgtcttgttatatgtacgaaaaaccaaaaagaaaaacagagaaacttctggttttatggatgatcaggatcactgatacaacgggcattctttcacggggatgtccgtttgtctgttttcatgtttcacatggaacattgcggctgtccgcgctcattttacttgcgatttcgacttatgttaaaatatatacgtgtattttggagagtttatggaaaattcaggtcttgaaagagacattgcggcgtcaaaagagcagtcgtctaagctgctcttttctattcgtatgttcgaatgatacaaggtttgaggtgagtaagtgaaaaatacaagggctctaatagaaggcgccattttgatcagtatttttgcaatcatttcccttttggtcgtgtacctccctttactgggggcaattcttctctttgctttgccgctgccgatcattctttacaccattcggcacggtctgaagcccggggtatggatggggcttgccagccttcctgtcagctttattgtaggttcgtttaccgggcttacaggcgcttttacggcggcctgtacgggaatcgccatgggatattattttaaaaagaaacagcccggctatgcggttgctgccggcgctatggcgtatgtgctgtgcggcgtcgttttttttgtggtcagcatcgtgtttcttaatatgaatgtgatcgataccaccatgtcccagcttcgggagtcgatgtctttagcagaaaccatgtcaaagcagctcggttacggagatcagttcgggaagcagatcaagctgatggaaagtcagctgagcacggttcaatatctttttccgacagtgctcgtattgaccggcatcgttttttctttcctcagttatgctatggcaaggccgcttttacggcgattttcccctgatcttccgaagatgaagccttttagagagctcaaactcccgcaaagcgttgtcattctgtattttattgtgacgatattagggtttctgcctttagaaaaagggcatatgctgtattcggtttcattgaatgggggatttattctcagcttgctgatttgtattcaagggttagcgtttatttttttctattgccgcgaaatggagatgccgaaagccgttcctgttttagcaattgtgctgggtgtgctttttccgctcatcttgtccgtgtatctcctcttaggcatcattgacataggctttaacataagaaataaggtgacgcgaaattgagtgtgacttacaggtggggagttgatagaaatgcctagtttttatgaaaaaccgttgtttcggtatcccatctatgcattgattgcattgtcaatcatcataatcctcatcagcatttactttaactggctgataggagccatcggcgttgtgctgctcgccgtgatcctgtttttcattaagcgtgcggattctctgatcagaaaagaaattgacgattatatctccacgttatcgtatagattgaaaaaagtaggcgaagaggcattaatggaaatgcctatcgggattatgctgtttaatgatcaatattacattgagtgggcgaatccgtttttgtcttcctgttttaatgaaagtacgctcgtcgggcgctcgctgtatgacacatgcgaggccgtcgtgccgctgatcaagcaggaggtcgattcggaaacgatcaccttgaatgagcggaagtttaaagtagtgattaaaagagatgagcggctgctctatttctttgatgtgacagaacagattcagattgaaaagcagtatgaaaatgagagaaccgtgctggcatatatctttttagataactatgatgacgtcacacaggggctggatgaccaaacgagaagcacgatgaacagccaggtcacctcattattaaatgcgtgggcgcaggagtacggcattttcctgaaacggacgtcctcggagcggtttatcgcggtgttaaatgaacacattttaacggagcttgaaaacgcgaaattttcgattttggatgaaatccgtgaaaaaacatccgttcacactgtatctttgaccctcagcatcgggatcggcgcatcggtttcttccttgaaggagcttggagatctggcgcagtccagcctcgatttggctctcggccgcggaggcgaccaagtggccatcaaaatgccgaacggcaaggtgaaattttacggcggcaaaacaaatccgatggagaaacgcacaagggtgcgcgcccgggtgatttctcacgcgctcaaggagattgtctcagaaagcagcaatgtcattatcatggggcacaaatttcctgatatggacgcagtcggagccgcaatcggaatattgaaggtggcgcaggccaacggcaaagaaggctacatcgtcattgatccgaaccagatcggatcaagcgttcagcgcctgattgaagaaattaaaaaatatgaagagctgtggtcgcggttcatcacaccggaagaggcgatggagatttcaaatgacgacacgctgcttgtcgtcgttgatacacataaaccgtcccttgtgatggaagagcgtctcatgaacaaaatcgagcacatcgttgtgattgaccaccaccgcagaggcgaggaatttattaaagacccgctgctcgtttatatggagccatacgcttcatccaccgcagaactcgtgacggagctgcttgaataccagccgaagcggctcaaaatcaatatgattgaagcgacggccctgttagctggtataatagtggatacgaagagtttttcccttcgcacgggctcgcggacgttcgacgccgcttcttatttgagagcgaaaggcgcagatacggttctggtgcagaaagttctcaaagaatccgtcggttcttatatcaagcgggcgaaactgatccagcatacagctctttataaagaacatatcgcgattgcttctcttcctgagaacgaagaggagtactttgaccaggtgctgattgcgcaggcggctgattccctcttatcgatgagtgaagtggaagcttcatttgcggtagccagacgggatgagcatacggtgtgcatcagtgcgagatcgctgggcgaggtcaatgtgcagattattatggaggcgctggatggcggagggcatttaaccaatgcggcaacccagttatcgggcatttctgtctcagaagcgctcgtccggctgaaggaagccattgatgaatattttgagggaggcgttcagagatgaaggttattttcttacaagatgtaaaaggtaaaggaaaaaaaggcgaaatgaaaaacgtagcagacggttatgcacataactttctcattaaaaaaggcctcgctgtcgaagcaaatgcgacaaacatcagcgcattgaaaggacagaaagaaaaagagaaaaaagaagcgattgccgagcttgaaagagcgaaagatttgaaagaaacgcttgaacagctgactgttgagctgagtgccaaatccggtgaaggcggccgccttttcgggtctgtcacaagcaagcagattgcagaagcgctgcaaaaaacgcataagattaaagtggataaacggaaactggagctccaagacggtatccgcacactgggatatacaaacgttcctgtaaagctgcaccctgaagttcaggctgtgctgaaggttcacgtaaaagaagaagcgtaatacacaatgaaaaacccgccgatccggcgggtttttttcatgtcagcagacggcgcagcgcaagaaaatgatgagattgtttcatttccgatcgttaccagattgcatattatattacatcataacgaaggatgtgtcggtatgaaacgatttttttctgaaacatattttaataatccggagaataaaaaggcgctggagcattatccgctgatcggagacggaaaagacggggaagtctaccgcttaacacacaacaaatgcataaaatacttctttgaaaaagggacatgcaagaaggaattggcggctttaaagaccggacaaggttccccggtgattccaagactgtatgaatacggagatcgttatattgtgatggaatacgtccaaggcacctctcttgcccgccatatcagaaaagaaaaatccctgtccgtcaaaatgactgctgatattttaaatatgctggatgaattaaaaagaatcggttttaccagatgggatgccgaaatcaggcacattctgatcaatgaacacggaaatcttaaagtcatcgaccataaaagagctttttccgctattacccggtttcccgtaaaactattaaaaggactggacaaatacggcttggcggatgagtttttgaatactataaaaaaattaaatccgtcacgttacctggaatggcagccgcacatgtaagtttctgaaaatccgcacatgtaagtttcctttttttagggtcgtcatatgatatttgtaacatttgtttggtggagtgtggaaaaaatggcagaatacattatggttatcggcgctcatcccgatgatgaactattgggagcagcgggcaccataaaacggctgatcaatgaaggatataaagtgatttccattattacggcattaggaagaaaagaagaagctcatcatattaaacaattaggcgaacgcgcgaatcaagagcttggaattgagaaagtcatctttttggagcatacgaatttagagctggaatgtatccctcttcataagcttgtcaaagaattagagcagctcattcgcgtctatcagcctgataaaatctttacacatcattacggcgatatcaatatggaccaccagagaacattccaagcagttttaacagccgccagaccgcttccgaatcaaaaacctatcgaactgcttacgttcgaaacgctatcttcaagcgagtgggagaggaatacggctgataaactcttcaaacctaattacttcgttaacatcacagacacaatggatgctaaactcgcggcgcttcaccactatgacgtagaaatgagggattaccctcatccccgttcatatgaaggcgttaaacatttaggaaaagtcagagggatgacggcgggtgtggaatacgccgaagcttttgaagtcgtgcggaggatctggaaatgatcaagacattttccgtcccgtatccgtatatggtccagacgcttgaccgctactacggggtcaaaacgcgccctcaaaaaaaggcggcagtaaagacacagttgaaacatgaacatcatattccgcggttatacaggaaaaaaaagaagttatccattttgattgccacgttttgggactacccgcacacgggcggtttatcaaactatattaaaacgcttagtgaaggcctgaagaagaggggtcataaggtggatgtcatctcccctaatctgtttccgtccgcacaggtaaaagaactgcgggcggctgttgttccgaagttaaaagatttctttaaggacagatatggggattataacaatcatattttgaaaaataatcggctgatgtttatatacgagcaaatgcttcaaaagattcatttggaaagatatgatgtgtttcatgctcaagatttatttacagccaatatattaggcagattcaatcaaatctataagaaacctttatttttcacaccgcatggcatgtttactttcaacagacttaaatttcacatctttaaaaaaggatcgatagaagagttttattataaaaaactagagatgaaagccattgaatacgcagatcgcctgattattatcagcgatacgttccgcagcccgctcatgaagctcggagccgaacaggaagacatgacaacggtgatcacaggaatcgattacgatgcaaaaacaggcgggaaaagaaaaatcccgctgccgaaaaataagatcatcatctcgtgtattgcaagattaggcccgagaaaaggacataatcatttgcttgacgcactttcacgaattccgtctgatgtacttgagcatgttgaagtgctgatcgcgggcgacggagagatgaggagcgccttagaggaacaggctcgaaaactgaatctatctatggtttcctttttaggaaaaagagatgatgttcccgctattttgaatatgacggacatattcgtactgccgaccgttaatgacagtctgcctatttcgattattgaagcgatgttcagcggctcggctatcatcgcgaccgattgcgggggtattccggatctgatccgccataacaaaacggggcttattgtcgagccgggaaatgcaaaggttcttgcccgggctttagcgttttttatcactaacaaatctgcgcggaagatagctgcttcaaacgcaaaggcctacgcggagaaatatttgagcagtgagacgatgataaaaaatatcgaatcgatttatcaaaataccaacagctcggagggagatcatgaaacatgaacatgcagccgttgtactagatttcagtgcaaacgggattgggatcattcgcagcctggcccgaagaggaatcgatgtttacgcatttgacacggagggaccttatcgtatcggaaaatcaagattggcagattgcgggatatgtcccagccctttaacacaagaggaagaactgctgacattcctgactgatttcgggaagcgattccaagcaaagccggttctgtatgcaggttctgatgattatgcgggatttatatctaaattccgcgagacattagccggtttttttttatttttgctcccgagccgctctctgttagaaacggtcttagataaaagcaaagcatatgaattagcggtcaagcataacatcccctgcccgaaaaccttttttccgaacaaccgggatgagctggaagaggccatcgccaatattgacttcccgtgtattttaaaaccggtggccggccatgaatacagaaaaaaagtaaacaaaaaagcaattgtaatgaaggatgccgcacaattgcgcaaggagttcagctcctacagagaaaatggagaactgctcgtgcaggagatcatccccggagacaaccagtgtttttataaagtcgccactttttatgatgaccaaatgaaattaatgggcttattctctctgcaaaagaaccatcaattccctgctgattttggcgcgggggcccacgtcgtcagcaaacggcttcctgatttaatcgagaagaccctgccgttttttgaagcgattcagctgaagggagtaggcatggcagaatttaaaaaggacccccgggacaatgtttataagtttatcgaaattaatccgcgcttttggctcagccatagcctgacagaaccggcaggcattcatttcgtttacatgtactatctgtatttgaccggacaacatgtgaagccccagctcgaacaaaaagacggaatcaactggatttatgaggtgcgttacttcttaacgtttttgaagaaacgaaaaagaggagaaatgacgttccgggatttttggaaaggatttaaaggaaaaaaagagtacgctctgtttgcttggaatgacccgatgccatttatcagaaacacttggtctcatctcaaaaacagctggaaacggaagcggaaggaagatcggcatgtatgaaaaggatcttttgtatgacgcatttcaaaaactgagaattgacgaaaaactgtcgtattcgttcggtgaaagggccgcggtgaatccggatgacatcacatgcctgaaatcaacagacagaagcgccatttataaactgtttgtaaagaaaaaatccggaattgttccgctgatattgaaggtgtataaatcttcacgtgaaaaaaacaaggtcgagattaatatatacgggaaagcccgttctgttttaggggatttgctgccggacatctatcttatagaggaaagtgaccatgaaacgtggatatttatggagtttgtcagccagatcagaggacagcttacatttcatccgaagcatttcaagtatattattccgtctgtcgcagaactgcacagccgcacctttgaaaacaaggctgtttctgacggtaaatggcggtcgtggctgccgctatacgaatcggaaaccatgagaaaagggcgtaaaaagcagatcaaaaagacagcggaattattggatagagctcttaaagatgagcgcacaaaggatatcgtgaagcctcattatcggcaaatcacaaacttgctggagcaggaggagccgggttttttccctgaattggtccaaaacggctcagccatcacacacggtgatcttcatatgcagaatatctgcacccacgatgcgtccggacatgaaccgtgggatattcaattcatcgattgggaatccgcaaagtacgcgccggtttggtttgatatgacggtgctggtcgaaattctgctcggcttcagaaaagactggagccggcacgcagaagatattcggacgtattgcgtaaaagtgtatacgaaagaaatgaaaaagcggggcattcattttcagacccctcctatgacgctttataaaatggcttatttgcagagaacacttgagaaagggcttcatacccaattgcggagaatcttcgacaatcggggaggagaactgctgccgtatcatgttgacaaagtgtcaaaatggggacgggaattaggattataagtttaagagagggggagcggatttgaaaggagagatcggcaagccgaacggtctggtgcctctaaccttattgcgcgtcatggatcaattttacgggatcgaacatcaaagtgagccggagatgctgtattcgttctgtgcggaaggaaaaagctcccccaaacgaaaaaagccattgcgtattctgtacgcaacctttctccgttacccgaatgtcggaggactggcgagttatatcacgtcaattaagacgggttttgagcgcatcggtcaccaggcggatgtcatctcgccgctccaaatgccgccaactttttttcaggaagatatcccgcgggccgctgacgagatcagagcgtttcttgttggcagatacggggccgcaaacgaaaagtttgtgaagaatctcagctatttacatgtctttcaaagatttttgaaggagaaggacttagaacaatatgacctgtttcacgcgcaggatttatttgcggcatttttgctgggataccttaatcaaacgtatcggcatccgcttttttttacgccgcacggacatttcacgaaaagccggatgaagtttcataaaatccaaaagggttcaatagaagaggcatatttcagtgaaatagaaaggcagggtattcgggcttcggataaaatcattacaatcagcgactcctttcacgagcccttgctggagtacggagcgaaggaggctcagctgacgactgttcataccggcattgacatccgggttgcacccgagccaaaacgtgctgaaaaggtcgtgattgcgtgcgtttcccgtctgaccgagcgaaaaggacatgatgtgctgctggacgctctcgcccgcatccggcaccatttatccggagtggatatatggatcatcggggacggaaacatgagagggtttctggaagagaagagacggaaactgggcctctcaaacgtgtttttcctcggaaaacgacatgatgtgccggcgcttttggctgaatcatctatatttgtcctgccgacattgaatgataatttccccatagcgatcatcgaagcgatgttctcaggtcaagccattgtcgcaactgactgcggaggaatccctgagatgatccggcacgaggacacagggcttatctgtcagcccggcaacagccgcgaacttgctgatgccctcgtaaagctgattacggatcagtctctcagggaacggcttggaaaagaagcgcgctcctatgccggccggcatctgcgtcaggaactgatggtttcaaaaatagaaaggatttatcaatcatttttctgaatgataccggcgccgcatggcaggtgcttcaagagcaaaataaagaggccggtgtttaactatccagcctctttccgagctgttttttcatctcatacagagtctgctgactttgtccgcccgggccgcctgtcattcctcatcgggctgagcctgtttttccggtgctgtatcggtcagctgagatttttgtgccgttctttttaatccatgagacaagctttgtgttgcctgaattgtttccggataataagaaatagttcacttttccttcgtcaacaagttttttcagctgtgagacggttttaccgaaattttcttcatggaaaaaagaggcggaaagccatcgcttccgcctcccgcacatatatatgagagagcagcctttatttgtgatcgttctctttttggatttcagctaatttggcaagcagaatgtgctgaggcatgtgcatgattctctcaagcggcatattcagtgattctgcgagcttttgcgccgtttcggcggaaatttgcagcggtttcatgtgatcactccttccgtttctttattgtactaaaatcagaaatctatcgtaagaggatatgacaaaggaatggaggtttgaaaagcggggctttataacagaatgggggaggttttttatgcaatcgccattgatgttattacagctgaagctggctgattatcagaaaaaagccgcagaactgcggacaattgacgaatttatcatactgaaacagacattgcaggacatgatgaaagtattcgccgcctttgaagaatgggagctgtatcaaaaaacggccgatctcatggcgcagacggtgctgcacatccgtttcatcgaataagaaaagccctcgcacgggcgaaggcttttcttaaaaggaacgttcctcttcaatgtttttatgctgatcataaatgacaagcttagccgggctgttctctttcgccatctgctccgctttttcaatcgccgcgtcctttgatgtacaaagagccgtcggcgccacattttccaccttcacaaaccatccgtccgcatcaacactgggtgttactgcatatgttttcatccttcttacctcccggtttcgatttatttatttgtttcccggcattcggaacggtaaaacacataaccctctcctgacaaatacagggaaagtgatatttttctattctttttcatgagaaatggtaaaatgaaatttggatattttttaaggaaaggacggtgcttagcatgacagaccttctgaatgatcggctgccgccgcaaaacatagaagctgagcaggccgtgttaggtgctgtttttttacagccgtctgcgttgacactggcttctgaagtgttgattccggatgatttctacagaatgtcacatcaaaaaatttacaatgccatgctcgtgctcggagaccgcggtgaaccggttgatttggtcacggtaacgtcagagcttgcgaataccgatttgttagaagaggtgggaggcgtctcttacctgacggacatcgcgaattccgttccgacagcggctaatatagaatattacgcgaaaatcgttgaggaaaaatccattctccgccgtttaatcagaacggcgacctcgatcgctcaagacgggtatacgcgcgaggatgaagttgaagatttattaagcgatgcggaaaaaacgattatggaggtcgcgcagcgaaaaaattcgggcgccttccaaaatattaaagacgtgcttgttcaaacatatgacaacattgagcagcttcacaaccggaaaggcgatattaccgggattccgaccggctttatcgagcttgaccggatgacggcgggttttcagcggaatgatttgatcattgtcgcagcccgtccgtctgtggggaaaacggcgtttgccttaaatattgcgcaaaacgtggccaccaaaacggatgagagcgtggcgatattcagtcttgagatgggtgccgagcagcttgtcatgcgtatgctctgcgccgaagggaatattaacgcccaaaatctcagaacgggtaatctgacggaagaagattggggcaagctgacgatggcgatgggaagcctgtcaaacagcggtatctttatagatgacacccccggcatccgcgtcagcgaaatccgttcaaaatgccgccggctgaagcaggagaacggattgggcatgattttaattgactacctgcagctcattcagggaagcggccgttcgagcgacaaccgtcagcaagaggtatcggaaatttcacgggcgctaaaagcgctggcgcgggagctcgaagtcccggtcatcgccctgtctcagctctcccggggtgttgagcagcggcaggataaacgtccgatgatgtcagatatccgtgagtcgggaagtattgagcaggatgccgacatcgtcgccttcctgtatcgtgatgattactatgataaagaatccgaaaacaaaaacatcatcgaaatcattatcgccaaacagcgtaacggcccggtgggcaccgtctcactggcttttgtgaaagaatacaataagttcgtaaatctggaaaggcgctttgatgacggcggtgttccggcaggtgcgtaaagcctcaagcaatgtcttgaggctttttttcatccgaaagaatgagagaatgccgtctgttcggcagtcgataaaaagaaagcgcttttatataatggcattaagggagggatgatgatgacaattgaatttccgcaatttcaagcggcgcaaatccggattgcccggccgaccggacagctcaaagaaatcatcaggttttatgaagaaggcctcggattgaagagggtcggcagtttttccggacatgagggctacagcggcgtcatgttcggcctgccgcatacgcaatatcacttagaattcaccgaagaaaccggctcgtctcagccggcgcccgttccgcacggcgacagcctgcttgtcttttacatccctgatcagcaggaggtcattcgcatcagcacgaaattaaagcagatgggatatgaggagaaagaacccgaaaacccgtactgggaagaaaaaggcgtgaccatcgaagatcctgacggctggcggatcgtcctgatgaatacaagcggaatataaatgactgtctgaagaacccgggatatgggttctttttcgtgttaaagtatgaaagtttcgggagtaatagatagcaaatgaaagagaaaacgcttttaatcaggtttaaggcgaacaaatatagaataataagattttaatgttcggatttacgattgactttctgtttcggcactgatacacttaatttgtttgaatgagatatcgttttgaaaggttaacggaggtgcacggatatatgtcttcagtagtcgtagtaggtacgcagtggggcgatgaaggaaaaggtaaaattacagatttcctatcagaaaatgcagaagtgatcgcacgttatcaaggcggaaacaatgcaggacataccatcaagtttgatggcgtcacgtacaagcttcatttaatcccatcaggaattttttataaagaaaaagcgtgtgtcatcgggaacggaatggttgttgatccgaaagcgctcgtaacggagcttgcgtatcttcatgaacgcaatgtgagcacggataacttgagaatcagcaacagagcccacgtcattcttccataccatctgaaactggatgaagtagaggaagaacgcaaaggggccaacaagatcggcacaacgaaaaaaggcatcggacctgcttatatggacaaagcggcgcggatcggcatccggatcgcagacctgctagatcgtgacgtgtttgcagaaaagcttgaacggaaccttgaagagaaaaaccgtctgctggaaaaaatgtatgaaacggaaggcttcaaaattgaagatattctggatgagtattatgaatacggccagcagattaaaaagtatgtatgcgatacatccgtcgttctgaatgacgcgctggatgaaggccgccgcgttttatttgaaggcgctcaaggggttatgcttgatattgaccaagggacatacccgtttgtcacttcatccaacccggtcgccggaggggtgacgatcggttcaggcgtaggtccgacaaaaatccagcacgtcgtcggtgtatctaaagcgtacacaacccgtgtcggtgacggtcctttcccgactgagctgaaagatgaaatcggggatcaaatccgtgaagtcggacgcgaatacggcacaacaacaggccgtccgcgccgtgtcggctggtttgacagcgttgttgtccgccatgcccgccgtgtcagcggaatcacagatctttctctgaactcaatcgatgtgctgactggcattgaaacattgaaaatctgtgtcgcttaccgctacaaaggtgaagtgattgaagaattcccggcaagtctgaaagctctcgcagagtgtgaaccggtatatgaagaaatgcctggctggacggaagatatcacaggcgcaaaaacattaagcgatcttcctgaaaatgcgcgccattatctggaacgcgtatctcagctgacaggtattccgctttctattttctctgtcggtcctgaccgttcacaaacgaacgtcatccgcagtgtataccgcgctaactaagaatttgcagcaaacaagcctccggtcacggaggcttgtttttttatgtaggaaaaaaataatagattttttttcaaaaaagtagttgccactttcgaatgttctatgatattataaatctcgttgttacggaacagcttcaatagagtactgcaagaaagcttttgtctcaatgctctatgatacataatccgacacatcaagagccattagctcagttggtagagcatctgacttttaatcagagggtcgaaggttcgagtccttcatggctcaccactttttatggcccgttggtcaagcggttaagacaccgccctttcacggcggtaacacgggttcgaatcccgtacgggtcattgatttactttagcgttattgctaactccttatttgtcctcggagggccgccacgatacggttctccggacaaattactgtaaggtccggtagttcagttggttagaatgcctgcctgtcacgcaggaggtcgcgggttcgagtcccgtccggaccgccattttactttactttatagtatagaaaagaaacatctggctcggtagctcagttggtagagcaacggactgaaaatccgtgtgtcggcggttcgattccgtcccgagccacttacccaaacgcatctgcaatagtaggtgcgttttttcttttgttataaaaaagggagagccggcttttcagccggcccagaagaagacgtcaaacactagacggcgttttttttcttaaggtttcaaaaaaatattattttttaaaagaaaataaaaaacatgacaaaaggatggcagttcaatacgtttttgcgctgttctctttaatttttttatcttttgacctgaaaccgttataatagacggggaacgtttttcacgatacgaattgtgatcatcatgaaacatcaatagatgaaatgaagtcattctggcaggaggaaaatcaagatgatggataagaaaatccttgtagtcgatgatgaaaaaccgattgcagatatattagagtttaatttaagaaaagaaggctatgacgtgcattgtgcgtacgatggaaacgaagccgtggaaatggtggaggagcttcagcctgatttaattcttttagatattatgcttccgaataaagacggagttgaagtgtgccgggaagtccggaaaaaatatgatatgccgattattatgctgacggcaaaagactcggagattgacaaggtcatcgggcttgaaatcggagcggatgactatgtcacgaagcctttcagcacgcgtgagcttctggcccgcgtcaaagcgaacctgcgccgccagcttacggttgcgccggctgaggaagaatcagcttctaatgacattcatatcggttctctcgtcattttccctgacgcttatgtcgtatcaaaaagagaagaaacgatcgagctgactcatcgtgagtttgaattgcttcattacttagccaaacatatcggacaggtcatgacccgtgagcatctgttgcagactgtgtggggctatgactatttcggtgacgtgagaacggtggatgtaacagtgcgccgtctccgtgagaaaatcgaggataatccgagccatccgaactggatcgtcacaagacggggtgtcggttattacttgagaaatcctgaacaggactaaccggcgatgaataaggttggtttttttcggtcgattcagtttaagatcacgctgatctatgtgcttctcattatcatcgccatgcagattatcggcgtgtactttgtgaaacaggtggagaattctcttctcaagtcctatgaattatcgttaaatcagcggattgacaatctatcctattatattgagcaggaatataaaggagataatgacagcaccgtcattaaagatgacgtcaaacggattttgaatgattttacgaaaaacaatgaaatacgggagattacatttgttgataaaagctatgaggtcgtcggttcttcgaggccttatggcgaggaaatagcggggaaacagacgactgacccgatttttaaacggattttctcaacaaaacaggcctattcaaaaaaatattatgatcctaaaagcaaaaacagagtgctgatttcagcaaaacctgtcgtcacagagaatcaggaagttgtcggcgcgatttatgtcgtggccagtatggaagatacctttaaccagatgaaaaccgtcaactcgattcttgcttcaggaacaggcttagcccttgttctgacggctcttctcggtatatttctcgcccgcaccatcacccatccgctatcggatatgcgtaagcaggcgatggaactggcaaaagggaatttctccagaaaggtgcggaaatacgggcatgatgaaatcggtcagctcgcaacgacattcaaccatctgacgagagagcttgaagatgcccaagccatgacggaaggggagagaagaaagctttcttccgttatcgcgtatatgacggacggtgtcatcgctacgaatcgcaacggggctattattcttttaaacagccctgcgcttgagctgctgaatgtttcacgtgaaacggctttagagatgccgattacgtctttattgggcataaaagagaactttacatttgaggatttagtagaacagcaggattcaatgctgctggagatcgaacgtgacgatgaaacgactgtactgcgggtgaatttttccgttattcagagagagcacggaaaaatcgacggtttaatcgcggttctttatgatgtcaccgaacaggaaaaactcgatcgggaacgcagagagttcgttgccaacgtgtctcatgagctgcggacaccgctgacgaccatgcgaagctatttagaggcgcttgcagagggcgcgtgggaaaacaaagatatcgctccgcgtttcttaatggtgacccaaaatgagactgagcgcatgatcagattggtgaacgacctgcttcagctttctaaattcgacagcaaagattatcagtttaatcgggagtggattcatatgatccgctttatgtcactgattatcgatcgttttgaaatgacgaaagaacagcatgttgaatttatccgcgagcttccggacagaaatctgtacgtggagattgatcaggataaagtgacgcaggttctcgataatatcatttctaacgcactgaaatactcaccggaaggcgggcatgtcactttctcagtcgatgtgaacgagaaagaagagctgctttatatcagcgtaaaagatgaaggtatcggcattccgaaaaaagatgtggaaaaagtctttgaccgtttctacagagtggataaagcgcgcacgagaaaactcggcggcaccgggctcggccttgcgattgcaaaagagatggttcaggcgcacggcggagacatttgggccgacagtgtagaaggcaaaggaacgaagattacatttactcttccatataaagaagagcaagaggatgattgggatgaggcgtgaaaatataaaaacagtcatactgtcagtgctggtcgtcattagtcttgttttaacatggggaatttggacattccagcccaatttttcagaaggcacggcctcaaccaaatcgactgtccgggaaaagcataaaattgataaaacgagccaaaaagtgtcgcaaacggtaaaaccccgggatatgtttattcatacaaacggctctcattataaagtggatgatgagacgctctttaatgacctgtgggcggatttgccgcaatgggaagtaaaagggatgaaggatatttccgatcaatacgacaagctcggttttaaaaattggctttacggcagaaacggcaattcggcaaagctcgatctgcaattcaatgacaccattccgattgatttcttccaatcgatgtttaaatggtcaaatccgtcaatggaatacagctcatttgaccatattgttattccgtttaatgagaataagacgaataagaagatttacatggtctcgtacagcaagcagctgattttggaagtgactgtggaatcggcgaattaccgcaatctgatgaatgagctgtacagcaaaaagtcgagtatgccgttataccacctctattcggtcggaaaaagcaaagaatttctcatgccgaatgcgcggtttaatatgaaggaaaaagaatttatcactgaaaccattaagacgaacctgtttaagcagacgctttttaatgatccgagcacggtcagagaggacccgaattacaatcggaatgtgctgactgacggaatcagccgtctggaaatcaattcgacacagcggcagattcaattccagcatcggaatttggcacaaagcgcttcttaccaaacgggtgagctgattaagaaaagctataaatatttagaggatacgggaagctggacggatcattatcaatttttcaatgtgagtgataaccagcagctgagtttctacatgtttaaagaccaaatgcctgtgatcaacagcacgtctaagcctttcggatccggacctgttttgaccctgcaatgggccaatgacgaggttctcagctacaagcggccgaactatgttctcgggccgaatccgattaaaacaaaagacgtaaaaatgatgaacggcaatgaggttgtgtctctgctggagcagcaggataaatacgacgtgaacaaaatcgaccagatcttcctgtcctatcaaatggtctcttcttcaacgaatgatctcgttgaactggaacccgtctggagtatgaagatcaacgggaagatcgtcccgattacgaaagatctgctggggaaggaggaggacgataatggagtggaataagacaaaaacgatcttcatcattgccttcctcatcctcgatatttttctcggctatcagttttttgaaaaacgctcgagcagtgaatacgaagtgattaaaaattcaaacgtggaaaaagacatggagatggaccatatcacattcggcaacctgtcttctgattccgcgacgggctaccggctgacggcgggccaaaaggtatttaccgctgaagatattgatgctttgaaggatcaaaagccgttaatggaaatgccggcggatgatcataaggtcacaacgctgaaaatgaaatttaccgatccggtcggtttatcgaagcaaaaaccgcaggaggatgcggaatcgctcgtcagttctaaagtaaccggcggtgaaaaatataaactgtggaaagtcgacaaggatcaaaaacagatcattttttaccagacatatgacggacagtttatttatcaggattttgactcgtccacggatgcgatcggacaggtgattctgcatctgaacgataaaaaccaggtcgtatcctacgagcagaccatgctggagtcattcaagcgaatccagaccgagagcctgattcctgagcttgatgcggtcgaattattgtattctcaaaattacttaaaagcgaattgcgccgttaaaagcgtcaagttcggctatattgcccaatacccgctgacaagtacgcaggtgctggcgccggtatggagaattacaattgaagataagtcaaaagggacgaagaaaaagacacagcaaacgtacactgtgaatgcattggaaagcacagtcattgataacaatcaaaataaataatggagtgagacacaatgggcttgcaatttagcgtgcttgcgagcgggagtaccggaaacgcgttttatctggagacagaggagcattcttttctggtggatgccggcctgagcggtaaagcgatggacgggctgatggagagaatcggccgcaagatagacgacgtcgacggcatctttgtcactcacgagcacagcgaccatattaaagggctcggcgtaattgcgagaaagtacggtctacccgtctacgccaatgaaaagacgtggaaagcgatggagaatcagatcggcaagcttgataccggacaaaagtttttgttcccgatggaaagcgtaaagtctttcggcgggcttgatgttgagtcattcggcgtctctcatgacgcggccgagccgatgttttatgttttccactaccaaggcagaaagctcgcgctgatgacggacaccggatatgtgagcgacagaatgaaaggcatcatccgttcggccaatgtgtttgtgtttgaaagcaaccatgacgtcggcatgctgcaaatgggcagatacccttggagcattaagcggcggattttaagcgatgtcggccacgtctcgaatgaagatgcggcgctcgccatgactgatgtcatcggcgacggcacatcgcgcatctatttggcgcatctgagccaagacaacaatatgaaggaactggcgagaatgtccgtgcagcagacattggctgcgaaaggatttgtcgccggggaaacgtttcagttatttgataccgatccgaaaattccgacgccgctgtgcgccgtgtaatttttccaaatgaatcatgattattaatccgcgatctgacccacactataagcaaatcgagtactcttgaaaggatttgagatagggtggattataatcgcgatgatgaacagtacgcctccgaacagccccgccgcagcaagagaggatactttctatcaagtctgatcggcgtcatcgtcggggccgcgctcatggctttcctgatgccgtactggacaggcggagaccatggagacagcagcaaaagcaccagccggcgtctcggcagcgaacaggtgaaaacagtcaacgtaaatgtcaatgacgctgtcacgaatatggtcagccgtgtatcggattcggtagtcggcgttctcaatatccaaaagactgatatttggggagagggcggcgaagcgggaagcgggtcgggcgtcatttacaaaaagaacggaaacacttcttatatcgtaaccaatcaccatgtcattgaaggtgcgactgagattgagatcagcctgaaggatggttcgcgcgtgcctgctgagctgatcgggagcgaccgtctgatggatctcgcggtactgaaggtgaagtctgataaaatcaaatcggccgcccagttcggcaattctgatcaagtcaaagtcggagaaccggtcattgcgatcggaaatccgctcggacttgaatttgcgggatcagtgacacaggggatcatttcaggcacggaaagagcggtgcccgttgactcaaacggcgacggacatccggattggaatgcggaagtgctgcagaccgacgccgcgattaatcccggcaacagcggcggcgctttgatggatatttcgggcaaggtggtcggcatcaactcaatgaagatcgctgaatccgccgttgaaggaatcggcctgtccatcccgtcaaagcttgtcattcccgttattcaggatttagaaaaatacggagaagtccgacggcctttcctcggtattgagatgaaatccttaacggatattgcgagctaccattggagccagacgctgaaacttccgaaaggcgttaaaaccggggcggtcattatgggtgtcgacgcgttttcaccggccggaaaagcgggtttgaaaaagctcgacgtgattaccgggttcgacggacataaggtcaatgacgttgtggatctccgtgagcgcctgtatcgcaaaaagatcggcgaccgtgtgaacatcacgttctaccgttcgggaaagaaaaaaacagcggaagtcaaactgacagaagcagatcgattacagaaataaaaaagcagcccggacatccgggctgttttttattgatttatttgttaatattatactattgtgaagcagggaggtgaaacacatgaaaacggctgatgtgatcatcgtattgaatgaaatcgagggtgaatgtgaaggaagaattattttagaatgcagaatttaagaaaatgaaacatgtcatattaaacgtcctttttcaggggcgcttttttttatgccttttttcagaagctataaaaaagaactgaacgcgggtcacaacacgttcagttgaaaatggatatatgtagaaaaaggcagacatgaccttagaactttgtgattgaaacagactggtgctgctgaatagcggcagatgaaactgccggcagcttatttgcagatggctccgttttcagcgtttactttcaccaattcagcttagcttccgttttgtttcagataaaagcgaataatagaaggggaagcgaaaaaaataaacacaggctgatacatctaaggagagactgcatcatgaataagttgaaaggcatcaagctgctgagtgcagacggcgagtctgcactcattgattctttaacgatggggcttcatcacggaacggttctcggggaagacaatatcgtcgagacatacattcgttctttgcgcgaaaagctgaaggacaaagaacacaaggtgattcgcacggttcggggcgccgggtacagggtggacctggcatgaaacggctgtacagaaccctgcggttccagctcctgttcaggtcactggcgattttgaccttgctgttatgtttcatcggcggtacacagtacatgtttatgagacggacgatgtatgaaaatcaggcgatcagcattcagagtgatatcaattcaatggatcaaagcgtatggaggtcaatcaaaacccctgcccgttccgaaacaccggctcatccgaatgtgatttatcccggggtgacggttgcttttatcaatcaatcatacaagatgtcagttttatcagaagacccgcacgcgggagccgctccttctttcccgaaaaacgtgtatcgggatgcgctgacagatacaatggcgcttcactatcaggtggctcacaataaggcgggtgaggaaatcatcgtcgtgtttcaggcgatttccgttgacggaaggcaggcgggagttgtacagatgagcacgctgacccagcctctgaatgattcgcttttccgccagatcagcattttcgcgatactttcctttgcggctttggttatcggactgtttgtttttttgccggtgatccggctcacactcaagccgctgtcccgcattgtgcatatgatgggtgacattcatgccggcagtctcgataaacggctgccgattgataggaagcaggccgaaattgagtcattgggcatctccatcaatcagatgctggaacggattgaaaccgcgtttcaggcggaaaaagaagcgaaggagcgcatccggcggtttgtatcagacgcatcacatgagctgagaacgccgcttacctccattcacggctttatcgaaattttaatgcgcggagcggcggaaaagccggagcagaaagaaaaagcgcttcaaagcatgtacgcggaatccgtcagggcgaataagctgatagaggatcttttgtttctcgcgaagattgaccgggagccgagctttgaaatgaaaaaaggggcattgggagacgtcattttggaaatggaggctgagctgaagctgcttgcgagaaaccggaaactcgagttctttgttgatcaaaagatagaagctgtttttgacaaagacaaaatgaagcaggccattctcaatctcttttacaatgcggtgcagcatacggatgaagacacgggtgtcatcaccgtctccctgcagaaagacggaggaatcatgcttatgattgcggataacggaacgggaatcgctccggagcatgtgcctcatgtgtttgaccggttttacagggcggaaacctcccgatcccgtcaatccggcggcgcggggctgggtcttgccattacaaaaaccattatcgacagccataacggaacaattgaagtgaaaagtgagcagggaaaaggctccgtgttcatcatccggctgccgggataaaccgggatagcggaagaaatatcacaatttatatataaattctaaattttcaaaaaataacttgtccttttccaatattgatgataatatctagttattggcaaagggggtgtgtactgatgaagattgaagaacttgatcttgatacagaaacagcaagcttggtgcatcgctgctagtaaagccgtgactcccctttttggggagttattatctttcagggggtatgtcatgatgtcaacggactgtaagcgctggaagtttaaagacagcgtgcaggtgctgacctacacggggcatattatcattcaatatcgaaaggcgattaagcttgcgcatacgagtgagatcaaagaggcggttgaacggctgatcaccggctgtgaaaaacaagagctttctgatcttctgggagaggaagcgggaaaccagtttttcgatgcgttaatgaaattggatgctttaatagagccatggcaaaacggccgtgaaggctgcatcactgaaaagcagctgtaccattttgagaaatacaaccaaaaccccaatctgatccaaaacagattagacggcagcagggcagcgatcgtgggtctggggggcgtcggaacgatcattcttcaaaaccttttggcggcgggcatgcagcattttattctcattgatttcgatgccgtatcagtacataacctgaacagacaattcgtctatactcaatcttctgtaggcaaattaaagatctcagaatgcagagattatatcgcgggtatcaatccccatgcggacgcagcactttaccatcaggaaatgacacagccgcaggacctgcgtgtgttagatccgtacgaaattgatatcgtcataaatgccgctgacaaaccccataacatttctgaatgggtttatcagtattgtaaggagcggaatatcgcgtttatgaccgggggtgtcggcagcttcagcggccaatgggggcctctgctcacgcctgaatcctatcaatccggcgtcacctatgaaaaaaacatgccggccggacttctgaactgttaccccgatgaaccgatcaaaggttcgttaggagcgacaaacggtattatatcctcgtttatgtctcatgacattatcacataccttgcaggcggaagcccgaaatccctgaatacccgcatcggcctggactttgacggacttcatattacagaaacgaagctttctcaaaaggaaagcgctttatgaagacgatgcatcgtacggcgagaaaaccgggcgaccctctgaaaatagaaatcgacacaagcccgatacgcttgaacccattagatacgcaggattacacaagcaagatgatttgcagcattatgtatgaaagcctgcaggacggctataactgccgaatcatccgcaaagatcgccgcacctgtcaggtggacattcacccggactatttaggtgacgccgagggtgtggttcaaacgatcatctatcatctgacaaaagaaaaccaaagtccccatctcggcagtttcctgaacataaaacaggccgttccgtatgtaaaaggcctcgtctcatccgatcagctcggggtgaacgtaacgggcgaaaaacgctttgaagtcaccttggacgagccgtctgatgaaatagaagccgttttgcagagcagctttctgattccggcgaccgccgggggcgatgtgccggaaaatggcccgtaccgattcaagcgtacgtttgagaagggactggaatttgagcggaatccgcaatataaaatgacgcccgcggatcaccgcaccgttcagatcatccaatttattttgaatgatgatctggaaaaaagcatctggctgtacgaagcgaatcagaccgatgtgacctgccacacccagtttcatcattccaacatgaggtatcggcagtatgctgattttaaagaaaatcatttgccgatgttatttaccttcaaggtaaaggacggcatgctgagaactttcattcagcattattttgataaacaaaagctggccggcgatttggggcatatcatcacaccgactgattcactgatcggtatatgggaaagcggacggacaccgcagaaagatccgccccttttgacaaaagaagagccgatccgaattgtttatgccgattattatcccaacggagagatcattgaaaggctgactgaattgtttcggagggccggagcggacgtatccgtctcccgcgtcagtcatttcaatgattattaccatatggataaaagcgggtttgatattgagcttcatttgttcctgccggcttacatgcatgagctgagctatatcaaatatttcattcgcgacatcagcgatccggggaagaaaaaaacgatcattgatgccataggatctgaaaaaaagaaggaactttttgggttattcgagaatacaactcattattgcccaatttgttttgggaaaagtctgtatctgcaagatccatgtatagagggttttagtgtaaagactgacgggctcctttctgttcatgatgttaaatgcagatagctggaaaggggtattcatttgcggaatcgaaatttgctttacttctccggttttttcggaaacttctttttcgaacggggaatttggattttatatttaacaagcatgaattattcattgtttctagtgggcatcctgcaatcggtcctgaatttggcgatgtttctggcggaagtgccgagcggcgtcatctcggacagaatcgggagaaaaaaatcgctcttgctcggtcattttatggtcattgtctatttggtgatgttcctgagcttccataacttcatcgccctcttcatcgctcatattatatacggtatcgggctgacgtttatatcaggaacggatcacgcctttttgtttgattcactgaaagaacaagggaaagaaaagtggtacggcaaatccatcggaaattataacggacttgtcatactcggtcttgcgatcgccatgggcatcggcggctacttgcaggaaatatcatggtcgtatgtgtttatcgccgggattgtgactcagctgattgcgatggcggtcattacacagctgacggagatcaaatttgaaaacagtgaacacgaaacgcagacggtcggggacatcttaaaagaagtcaaagatttcttcaggctgaacaaagcctttaaatatttggtgctgtcactctccgttttctttgcgattacatcggttttttatatgtacggacaagatctgttaagtcaggaagggctgtccgtgcgcaatatatccattatttttgcggggctgtccatcttgcaggcactgtgctccatcttttcttcaaagccggcggaaaaattcacgccgaggcgcgtgcttctgctgacattctgcatcatcggggcggcctatctgtttataccttcgggcagtctgtacgtgacgattgcagcttttgttgtcatcaacgcgctctatgatgtgatagaacccgtatccagtcaggtggtgaataatgagattccgtccagaacgagagccacgctgctgtccattatcagtttgatgacctcgctcttcatgttcattgcctttccgtttatcggattcttaacggactattttgattcagctttgctgctgaccgcaatcggggtattatccatcttattgtcgctgtttatgatgctcagcttttacaaactgaaagcgagcgtcgccatccagaataaagtcgagctttgaaccagaatgacaaagggatgatgtgagttgctgaatattcataatcttacggtaaatttagcgggagataccattttcaaacaagtttctttcttcatcaatgaaggcgaaaaagtgcttgtggccgggccgaacggttccggcaaaagcacgctgttcagggtgctttcaggggagcttgaggcggatgaaggaacgattgcgatcaacaaaggggcgaaggtcggtttgctgaagcagatcgctgatccccatgaggatctgacgttgtatcaatatctggaaaaatcgtttgaagctctcgcggcgatccagaaggaaatgaaggccattgagctgaagctttcggaaccgatgggtgaggacgagctgactgctttattggaaaagtacagtcaatacacggaaacatttgagcggaacaacggctaccagatgcatgcgatgattgacgaggtatgcaacgggctcagcctcagcgaattaaaggatcagccgttttcaaagctgagcggcggcgaaaaaacaaaagccggccttgccgaaattttaatccgcaacgacgacattatactgctggacgagccgaccaaccatttggatgttcatgcgattgagtggcttgaagggtttattaaaaaatcgaataaaaccattctgtttacgacccacgataaaacgtttgccgaccagacggcgatgaaagtgctcgagattgacgataccgaggtgaagatttggccttacggtttcagcgaatacctgaaaaagcgggaagaattcatcatcgcccagtttgagaaatatgaagaacagcagagaaaaatacagaagatgaaggaatccatcgcccagctgagagattgggccaaccgctcgaatccgccgtctgtcgggctgcacagacgcgcgaataatatggaaaaggcgctgaaaaggatcgagctgatcaataagccggtccggacggagcaaaaattaaaaaacgcatttcaggaagcgggcgccggttcaaaagatattgtgttcattgaaaacggaaaggtggccaacggatcttcccttttatatcaaaatgtgaatctgcgtataaagcataaagacagaatcggcatcgtcggcagaaacggcgtcggcaaaacaacgctgatccgctgcatcatcggggaaagagaactgtcggacggcaccattaaagtaggggaaaatcttaagataggctacattgatcaaaagagccacgtcggagattcgagtcagacgattctgcaattctttaaagaaaatctgctgactgaagagggcatggcccggaatatgctggccaagtacggattttacgggtcgtcggtctttaaaaaactttccgtcctgtcgggcggtgagagaatcaggctgaagctgtccatcttaatggaaaaaaagctgaatgtcctgatcctggatgagccgaccaaccacttggatattgaatctcaggaaattctcgaaaacagcctgatgcagtttcaaggcaccatcatctgcgtttctcacgacagaaacctgctggagaagttcaacaagattttctggcttgagaatcaaaacgtcaccatcttttcaggtccatacagttacgccaaacaaaaaaaacggcagattgccgaataaaaggggaatggatatgaccattgacagactgacaatcaatgagttatcgtacgatctttttgtaagcgagtatgctgataagaaaccttttattttgacgggggcaatggatcactgggaatgcaggccgtggacgcttgaatacattgacgaacactatggagacagaatggtcaccatccggaaatcagatatcgaaggggtcaaaacgtttaaacaagtaaagctttccaactatatcgagtacattgatcagaatgatgacaaatggtactgtgactggaattttacgcagctgaaccaaaatgacttagaccttgtctattccgcacccgagtattttacaaaagacacattgagagcggatgaagaaacgggacgggactggaaatggttctttctcggttctaagcagacaggcacgccgctgcatcaggattttaacagcacgcacgcgtggaacggcgtcattttcggggagaaggaatggattttctatcatccggacgactctccgtatttgtacgaaggaaatatcaatgtctttgatgaaaaagatatagagcaaaaaccgctggcgcaaaaggcgtctccgatccgcttcaggcaaaaggcgggagaaatcatttacgcgccgcgccattggtggcatcaagtcgagaatacggaacatacattggcagtgagtgagaacttttggtttaccggagagcggcttgccaatcagatataaacgaaaggctgaggagcacctcagcctttttttgtatggattcatttcatccggtccagaccgaattttttcaggcggtattgcaggctctgcctgctgattccgagctcgtttgccgttttggatatgttattgccttgttttctcagggttttttcgatcatgtatttttcgaagttttccattttgtcttttaaatctgtgccgggctgggtgcttgcggctgctttgctttccgtgtcagcgggtttgattttcatccggtattggtaaggcaggtgggccgccgtaatcgtcgtttcatccgtcataaagttcatggcgccttcaatcatatgttcaagctcgcggatgttgcccggccagtcatactccaggaaaaattgctgcacatcgtcactgatcgaatcgacatgcatttgaaacaggtggttgtttttctgaataaacacttcggccagaggcagaatgtcttccttgcgctcccggagcgggggaatgatcagcgtgacaacgcttaagcggtagtataaatctttgcgcagccgctcttctgaaatggcggtgatcgggtcttcattcatcgtggcgatgatacggacgtcaatcggtttgtcctgagctgatccgatgcgcctgattttcttttcctgaagggcgcggagcagttttgcctgcaggctgagattgagagagttgatctcatcgaggagcagggtgcctccctgcgcctgctcaaataagccgggctggtcgatggctccggtaaaggcgccttttttcgtgccgaataaaatactttcgaccagactgtccggcagggcggcgcagttttgtgagatgaacggggcgcctgagcgctggctgccgttgtgaatgctttgggcgaacagctccttgcctgttcccgtctcgccggccaaaagcacggacgatgatgtacgggttgcccgtttcgcgttttcgatgacttcctgaatgaccgggctgttgccgagaatgctgtcaaacgtgtagctgttctgttcttttctgtgcatgttctccctgatcagccgttcgagcttggtgacgtccttggcgatttccacggcgcccttgatctcgccgttttgcacaatcgggaaggtgtggttgatcgtcgtgatttcctggcctttgttattgaaatagctctgctttacatttttaatcgttttgccttcttgaagggcctgaacgagcgtgctgtcctgctgattggaaaacataaatacatcagtcaggtttttatgcaggacgtcccgttcatccatatcttcaatctgcatcattttcttattgtaaatgacggtgctgcccttctcatccaccacatgcagcccgacatcaatctcttccagaatgctttgtaacacgagtgtgtaaaattcgctggttgtgtgcaggtcaattccccctctcaatcgtcttaacattcattattttaaaataaatcgaacaggaaacgcaaaaaaattttgcgcttggctgaagtttgcacgcaaactgccggaatattttgcaggaaaagaaagaatgctggcgaaacatcccgttttttcggattggcacggaacttgctttataaaaagggaaagcaagatctaatgttgaatgattacaaaacaagggggaatcagattatgtcagctttcacaaaatctcaagaaattatcagtcaaacttcacattacggcgcgaacaactatcatcctctgccgattgttatttccgaagcgcagggtgtttgggtaaaagaccctgaaggcaatcaatatatggatatgctgagtgcttattccgcggtgaaccaggggcacagacatccgaagatcattcaggcgctgaaggatcaggcggataaaatcactctgacgtcacgcgcgttccataatgatcagctcggcccgttttatgagaaaacagccaagctgaccggaaaagatatgattctgccgatgaatacgggggcggaagccgttgaatccgctgtcaaagcggcgagacgctgggcatatgaggtcaaaggagtagcggataatcaggcggaaatcattgcgtgtatcggcaacttccacggcagaacgatgcttgcggtatccctttcttcagaagatgagtataaacgcggtttcggacctatgcttccgggtataaaattaattccatacggggacgcagaagcgctgcgccgggcgatcacgccgaacacagccgctttcttattcgaaccgattcagggagaagcgggcatcgtcattccgccggaaggatttttacaagaagcggccgctatttgtaaggaagaaaatgtgcttctgatcgctgatgaaattcagacgggactcggccgcacagggaaaacattcgcggttgattgggaaaatatcgtaccggatatgttcatcttaggcaaagcgctcggcgggggcgtcttcccgatttcgtgcatcgcggcgaaccgtgacattctcggcgtgtttaacccgggttcccacggctcgacattcggcggaaacccgctcgcttgcgcggtatcgctcgcatctcttgaagtccttgaggaagaagggctggcagagcgttcccttcagcttggccggtattttaaagaagagcttgagaaaattgataacccgatcataaaagacgtgcgcggacgcggcctgtttatcggtgttgaactgacagaagcggcccgcccgtactgtgaaaagctgaaaggcgaagggcttttatgcaaagaaacacatgataccgtgatccgttttgcaccgccgttaatgatttccaaggaagacttggactgggcgatccaaaagatcacaaacgtgcttcaaaacgcgtaataccttgatgcggcaatgctttccctcggcttgtatggaatttacaaataaaaaattcagcacactctatttgcgcggagacagtattttagtataatgtatctttatgtacgaaaatgaatttcatataacattcatatacaaatagaggctctttggacagcaaatcggtttcaaagcaccggcttggttccaatacaagttgctgaaggggtgcagaatagtgaatacaaatcaaaaagagaatcagcttcagcgcacaatgaaatcgcgccatttgtttatgatttcattaggcggagtgatcggcaccgggtttttcctgagtaccggatttacaattaaccaggcgggaccgctgggcgcggttctgtcttatctggtcggcggttttattatgtttttgacaatgctctgcttaggcgagcttgcggttgcccttcccgtatcagggtcgtttcagacgtacgcaaccaaattcatcagccccgctttcggtttcgcattcggctggctgtactggctcggctgggcggtgacatgcgccattgagtttttatctgcgggacaattgatgctccgctggtttccgcatgttcccgtatgggtgtggtgcctcgtgtttgtcggactgatgtttcttttgaacgcgattaccacaaaagcgttcgctgagtcggaattttggttttccggcattaaaattttagtcattctgctgtttattattttgggcggtgccgccatgttcggcctgatcgacatgaaacacggcgagcaggctcctttcttctctcatttttatgaggatggattgtttccgaacggcattaaggctatgcttattacgatgattaccgtaaacttcgcgttccagggaacggagctgatcggggttgccgcgggagaaagtgaaaatcccgagaaaacgattccgcgctctatccggcagacggtatggagaacgcttgtctttttcgttctctccatcatcgtcattgccggcatgattccgtggaagaaggcgggagtggtcgaaagcccgtttgtcgtggtgtttgaacaaatcggtattccatatgcggccgatattatgaactttgttatcttaattgcgctgctctcagtggccaactcaggcctgtttgcatcgacgcgtatcttatatgccatggcgaacgaaggacaagcctttaaatcgctcggcaaaacaactaaacgcggcgtgccgatgaacgctctgatcgtgacgctggccgtcgcctgcctgtccctgctgtctaaagtggcagcgccggaaaccgtttatatgtttctcttatcattagccggactaagcgcgcaggtcggctggattacgatttccctgtcacagctgatgttcagacggaaatacatccgcgaaggcggcaaagtggaagacctgaagtttaaaacaccgctgtacccggtgctgcctattatcgggctgacgttaaatacggtcgttctgatcagtctcgcatttgattcagaacagcggctcgccctttattgcggcatcccgttcatggcggtgtgcgttatcgtctatcatctgtatgtaaaaaagcataagcagtcagaaaaacagatagagctttaaatcttttcgtgtccaagtcatctttgagaaacccgcacaggacaacatacaacatgttgaggtggaaaaacggatgaacaagaatatctcagttattggaatgccgatggatttaggacaagcacgacgcggagtggacatgggcccgagcgccatccgctacgcgcatctcattgaacggttatctgacatggggtatgcggtggaagacttaggcgacatccccgtcaatcgtgaaaaactcaaacatgatgaagagctgaaaaatttgaactctgtgctctcggggaacgagcagctcgcccaaaaggtggacagcgtcattgagaatgagcggttccctctcgtcttgggcggcgatcacagcatcgcgatcggaacgctgacaggaacggcaaagcactataaacagctcggcgtcatctggtacgacgcgcacggcgacttaaacaccctggaaacatcgccgtcaggcaatattcacggaatgccgctggccgtcagcctcggcgtcgggcacgacacgttggtgaatctgggcgggtatgccccgaaaatcaagccggagaacgtcgtcatcatcggcgcgagatcgcttgatgaaggcgagcgtgaatacattaaggaaacaggcatgaaagtctatacgatgcatgagattgaccgcctcggcatgacaaaggtcattgaagaaaccattgactacctgtcagactgtgacggcgttcacctcagccttgatctagacggccttgatccgagcgacgcacccggcgtaggcacgcctgtcgtcggcggcatcagctaccgtgaaagccatttggcaatggaaatgctgtatgatgccgacatcatcacttcagctgaatttgtcgaagtcaacccgatcctcgatcacaaaaacaaaaccggcaaaacagcggtcgagctggtagaatctttgttaggaaaaaaactattataaaatatgcgcctccgcacctgcggaggttttttttgttgccacgaggaaactagcgggctgccaccctctttttggacctgtaaatatgatatatttattacacaaaatgggaaagggaggtgtcctgacagatggctgaggtgatggcccacgaaacagttgcgaaaaaaatcagtgactggtatgaggaaatcaaaaagcacaacactgaatcggctgaggcgttaagagaacaactgcttacggatctgcaaaatatgacacaaaatcaaacggtgctcctttattttaatttaattgattcccgctataagcttttaatggaagagtatgagaaaacagacggcattttaaaaacgatccagctgaacgccgataaagaaaaaacagaccagatgattcaatactattattatttcttttccggaatgcacgagttttaccgtaaacggtttatgaacgccattaatttttaccggattgctgaaagcaggctccggcacataccgaatgagattgaaagagccgagtttaattatcaagtggcgattgcctactatgaaatccgccaaaactactttgcgatgaaccacgcggaaaaagcgttggagatctacaaagccaatgaaatgtacgcggtcagagaagcacagtgtttaatggtgatcggctgtaacagaatggacttgttccactatcagaaagccgaagagctcctgcagacggcggttcatcaagccgccaaagcgggcgatccgcatattgaagcgctcgcccactttaacgcaggcatttgctatgaaagacaggaaaaactggaagaggcgcgggtcgagtttgaaacggctcttgatcaaaaggagcatttgcgatcagcgtattcggtgcggagtctgtacatgctggccagagtgttattgaagcaggcaaagacggatgagggccgattttggctgcataaagcgctgaatgccgctgaagaaaaaaacgagcccgtatacacccaaaagctgcgcatcttacagcatgtctttattgaccgcaatgaagaagcgcttgaatcagctttcgccgagttaagaaggaaagagctgtggagtgacgtttccgatttgtcgtatcaggccgcggcgcattttaaaaaacaggagaaatacaaaccggcggcgaagtattttcaggaatcaattgatgccaatgaccaaattttgagattaacggaggggattcgtaatgaaaacatgtaaattcattgtactctcagcagccttggcaagtctcatttcgattggattatttgcacaaactggttcaacggcacaagccgaacaaatcataaaaccggcggaaaacggagccttcggataatactgcatgatatcgctttcgtgtaaggagtgattcaatggctatcacgctgcagccgatgacaggacaagagtttcagtcctatctcgctcattcaaccaagcattacgctgaagaaaaggtaaaagcgggaacgtggctgcctgacgaagcgccggaattagcggagctgacgtttgaagacctgcttccagacggcttggagacagccgatcactatttatggacgctgacattggacggaaaggaaaatgccggctggttgtggctgcacgccgatccggaccacccgcagcaggacgcatttatttatgatttcggccttcatccgcctttccgcggcaaaggctatgcaaaagaggcgctcgcaaggctggaggacaaagccaaagatctgggtgtccgcaagatttctctccatgtgttcgctcataacgaaacggcgcggaagctgtatgagaagacgggattcctggagacggatgtcattatgagcaaaaagctgtcatgaaaagaggcccgcacgatgggcctcttttgttattcatctaacaatgtcatcatttgttccgggtaacgctcgccggccgccgtgccgatcggaaacatttcatccaaccgcgccttcacatcctccggaagcacaatgtcgagagcggcgaggttctcttccaagtagtgtttcttttttgtacccggaatcggaatgaggtcatcgccgtttgcgagaacccatgcgagcgcaagctgaggcgcggtgatattcatttcccgggcaatggcggtaaatttttggacgagccctatattcaccgccaaattgtctccctggaatctcggcgttcttcttctgtaatcatcggcatccagctgatctgtcgacgtcatctttccggaaagaaaacctctgccgagcggactgtaaggcacaaatgagatgccgagctcacggcaggcgggcagcacatgctcctctgcttccctgctccataaagaatattccgattgaagcgcggcaatcgggtgaatgcggacggcgcgcctgatcgtttctgcggaagcctctgacaatccgatatacctcacttttccttcgtcaatcagcttcttcatggcgccgacagtttcttcaatcggcacccgcggatcaacccggtgcagataataaaggtcgatataatccgtcccaaggcgtttcagactggcatcacacgcttttttcacataatcgggccgtccgttgatttcgataaactcacccttttcgcttcggacataaccgaatttcgtcgcgaggcacagctcctttctgaatggggcgagcgctctgccgacaagttcttcatttgcacccaatccatattgatcagccgtatcaaacaaattcacgccgagatgaacggcatgatgcagtgtggagatcgactcttcctcactctggctgccatagtattccgacatgcccatgcaccctaatcccattgcggaaacccgcatcgaaccgatcgttctgtccttcatatgtcctccccctttcttgtatgataaccagatttcctgatatttgaaaatgatttatgtatatgatttacatattgttataaaatttttaaaaatctgtaaattgtatatttttttatcacaatttcgtcatataatgaaaacgtggaaaaattaacctttgagaaaagaggcgaagtcaatgtgtaaaaagctgttcaaagccgtcctcccgtttgccctgtcattcaccatggttctgtcgttctccggtttgaatgtaaaagcgaaagaaacagaaataccacgctacgcaaaagaaatcgcagaccttcagcagggcacgactcctcaagacgttctccaatccgccaaagagcttgccaaacagaagcacgtttcaacagaagcaattctcaagcagtttcatcaagaaatcacggcagacaaggtgcaaggaaatgtaatcgcttccaaagacggactctctgcgatgggcggatcgtcaggaaccaaaaaactcccgaaaagcacaaaaggcaatatttattacacgaactcatacacggcttattacaatcacgggcatgtcggcatgtattcatccgctgataaaattgtcgaatccgtgccgggagacggcgtccgtcagattgcttataacggcagagaagtcgaagacaattcaatcgtccagaccgtgaaagttaccgatgctcaaaaacaagccgccgctgactgggccgtatcaagagtgggtgatgagtactccttcaacttcgtcaataacagaaatacgggccatgaaggcgccaaaaactgctcaaaactgctgtggtcggcattccttttaaaagcggggattgatatcgactctaacggcggcttaggcgtatacccgcgcgacatcacaagctcgtcctacacaaccacgatcctgaccattcactaaggagaacaacgtgaaaaaaatcatctggatacccttagtgatcatcgccgccgcagcggtcttatgcttcttctatttccgcacggaagaccctgcggaggttgcgagagacacattaaatgaccctgattttctgaaagataaagaggcgttgctgtatttctccactgcggctgaccaagacacgttcggcggcggaaaaagctacgccctcttcgccgatgaaaaagggcggctttcttcttatcaaatgaaggggcttgagctcggatcggccaaagtgcatgacgaaagcgtgctgctggaggacaaaaaaggaatctacaccgttcaggacggccttcacacgtataaaagagcgtaccagcatacgggagacagcgcgggatatatcgaacgggcgaaaggcttttacacgctgtataattcgggctacgacaagagcggcggcagctatcgctcagagctgtaccgccagatggacggcaggtggaagcaagacgtcatcccgcactatatccgcgcctcaggcttttttaaagatcatcttttcgcgctcacgccgacagatgacgaaaaaggctatcacgtccaagacattcaggccgataaagaaaagctccatacaacatcaatcgcgacgtggacgtataaagaaggcacgtctgtcgaatcccagctcgccgtggacgacagcgctgtctgctttgttaccagaggagaaaaagccgatcacatctatcaaatggtgaaagtcatgaaaaacagcggcgccatcaaaacgtatgacatcgccgcttataaaaatgacgaacagacgatctatgactccatgccgttcagcttcaaaaaaagctttttcatggagcatcgcagcttctatttcgttgacggcttcggaaccgtctaccgcatcaaccctgagaccggaaaaagcaaaaaggccttcaccctccccgcatcacgaatgaaggccgacttcaaggagctgacccatcaaaacggaaagctgtatctgttcacgtacagctacaaaaagcccgccaaaatcgaatccttcgacctgaaaacgggcaaaaagctgaacgacctgaccatcccaaacttaaaaaacatcgtcacgccgaaaagccatctcaagctgtatgatgtgcaggtgatggatgggttttaaagagtatgaacatttcggaagagcttgccgcttttggtaagctttttataatgaaacgttactgcgggaaagaaggtgttcatttgaaatcattcagtatcttcttattgttgtccgtcatttgtataaccattgtttttgtcataatgaatatgttgattggataccctgatgtgagtaacggggcattgattatgattgtatatatcgttgtgaccctcatgataaggctatatagcaagaaaaagaaatagaggaatttgaaccgtaaaagcagaagacagtcagatgaaggagggagccgatgaagaaaaagcttgccgcggtgaccgtcaccattctcctggtttccgtgataaccaactcttttttaaacggcggaaagccggactggattgatgtatgctgtacgctgctggcgtgtctattaggaattctgttcgtccttcgcttagaaaaaagagaaaacacgtaaagagccggatgctgaaaacaccggctctttttgcgcgtgatttgccgaattgtggataaaactcagcccgaagcactactaacatgtgtataaataggttatattgaaaagagaacaattgccgcgcgcaaaagaaaaccggaggatgtaacaatgaaaaccgcttattattcttgtgaagaacatatcgaaaccgtgctggacatgtacatagatgatcatgagcttccgcccgaaatcagaaaaatcgaacatactaacagtttatccacagcctgtgaattatgtggggacactgcaacatatctagtagggaacgaatgatcctacacaaaatacagaaaagatatccacaattgtggacaatatatatgaataacttgtttctaaagtggggatgacctgtgaatatcaatattgtgaccatcggaaaactaaaagaaaaatacctcaagcaaggcattgaagaatacaaaaaacgactctcagcctacgcaaaaatcgacatcatcgaactcccggacgaaaaagcgccggaaaacctgagcgaccaagacatgaaaatcgtcaaagacaaagaaggcgaacgcatcctggccaaaatcagcccggacacccacgtcatcgccctcgccatcgaaggaaaaatgaaaacatccgaagaactggccgatacaatagataagctggcgacttatggaaaaagcaaaatcaccttcgtcatcggcggctcactcggcctaagcgacgccgtcatgaagcgcgcagacgacaaactgtcattctcaaaaatgacatttcctcatcagctcatgcggctcatactagttgagcagatttaccgggcgtttcggattaatcgtggggagccttatcataagtgagtgaggtttgcaaataccattttcttgatgtattcagcataaaaataatcgttaaggatcatattttgttataatatattcatatggaaatattatgaatgaaaggatgaccattttggaaagaaaaatagatttacttatgaactcgcgtttcggggagagggtagccgaagaggatgagaatttagcatcgtattttgttgaaacggcagtatggaatcaattgttgatgggggaaattgatgtagtccgaggagtgaaaggttcaggtaaaagtgcattatatatgcaattattaaaaaaagagggtagttttgctgcgaaaaacaccttattaatacctgcagaaaacctagagggcacacctgtttttaaatctgttcttggtgatgctgatttaactgaaacctcgtttcagtacctatggtctatctatatcattactctgataggtgataaaatcaaagattttcgtaatagaagcgaagaagtaaaagattttattagaagacttgaattagaaggtttattagaaggtaaagggataagacgtctccttacgaatgttagagattatgtttttgaattctttagaaatgtaaaagaagttgaaggagtagtaaccgtagaacctacaactaatatacctattttaaaagggaaaatctctttaaatgaaccaagtaaagaacatagagaattaggagctatatcaatttttgaacttcttgaaatggctaatgaggcacttaaaagtgttgacttaagcgtttggataacatttgatagacttgatgtagcatttcccggaaaacctgaatttgaaaccttagctctaagaacactttttcaggtttacaataatataaaactgcacaaacatataaaattaaaaatctttattagagaggatatttggaaacgaattactaaaacgggttttagggaggcaagtcatataacaaagcaagtgacgattgattggtcagaacaggattttttacatttactggttagtcgtattcttgaaaacgatattctttgcaaattttttaatgtggaaaaagatgatgtattaaaagatagtgacaagcagaaaaaaatattctattctattttcccgaaaaaagttgaagtaggaaagaatcctgaaacatttaaatggatgattggacgggttaaggatggattaaaaataacagctccaagagaactcattcatttaatgaatgaggctagggcaaaacaaattaaattgttagaaactggtactccagaaaactcttattcagaaatcataggacgaagtgctttgaaggacgcattaaaagtagtatccaaaattcgtttagagcaaacaatttatgcagaatatgcacatctaaaaaaatacatagaaaaacttgaagaccagaaaactgaacatgatgttggtaccctttcaaaaatatttctaataaacaaagaagatacaataaatattgcaaatgaattagtgtctattggattttttgaggaaaaaaagggtagtcataaaccttattggacaccatttctatacagagccggacttaatatggttcaaggtaaggaagactaatattatagagataagagtaaagggggagtataaagcttccctattaattttttatgcttaagtaactctatattagatttaaaaaaattcacataaagctacatcaattctcaactgtcattagtcttaattaagcttgttaccatagggatgtttcgaagactttaatcaaaaatgattcaaatctcacttagatagagactatgataaattttatattatttaagtcgtcatttaattaacgtttattacaatagaaatataatctatagagggtgttgaaatttgaagaatgacattttgttacctaataaaattaaagtttttataagttcaaggtgtggacaaggttttgaaaggtatgatgaagtaagaaaacaactaaaaaaacttatcgaatcgacaaagattgctgatgtatatctatttgaggaaagtggagcttcgacacagtccgcagaacaggattatttatatgccctagatgatagtgatgtatgtctattcttaatagataataaagatgatgttacatctgcaattgttagagaaataactagagccaaatcacacccaaaaaagtcaatatatctattttgtaatgaaaaagaaagtaaacctacgcaaatccaagaagaacttattggagcaaaaggagctaaatattatatagttaatagttttaatgaatttgcaaatcaaggatttaaagatttaataacagacatatgtaatatttatagacactattgtaaaaatagactcatagaccaagaatttcacaattctgaacagaataaaatagaaataggttcaatagcttctgaatcactagagaaacgtattttacaaggaattgataaatcaaaagcatatatcggaaaaaagatattttctgttaataaagaagtgaaagaaacgagtgaattagatagattttatgagcaatttctaaaagtattatttggtgaaaaaagtattgaagaattcaatggggatttatttttagagcaaataaaaaaagagcaaagtgataatatgcatctagtagtaaaattaagatggaaagctattcagttttactggctcgatgattttgattctgtattaaaatacttaaaggaagcttttgacttatgtaaggaaagtgggttgcctgattggatttcacaggatatactgatagatttaataaatatagaaaatcaaaagttaaatcaggaaaataaattctcctctaggaatgctgcacaagaagagttagaaagtatgcgtcaatctctgttttacccatcaattgatagatatgaaaagctattatataaagaaattaataaagcatcaacaaaaaagaaaactgaaactgtgtatactgttaaccttggtagtaatttagatgtttatattaaatatttgactaacatttatattgttggtgcctttaatggatctttaactcaattattattattgagaaataaaataaaagatatatcatttcaattatgtgaggaatattccaattgggaattcagagtgttgctgttaaaaatggcagtaatagttggagatagcaagcaaacagaaaatataatttcctactttaatagcatattaggaaaaatcaattatattgatgtaaaaaatatttataattttacaaactgcctcccggtaaaatcagaaagaataaaatctaagctagaagtatttaaacatttagggtattattttagcgatgaagattacatgtgtatcaaaagagagttattggaagagattcataattatattgataatacttttatagtgtctatgggaaaattaatatttgattctttgaaagaaaatatcaatagaatcgaagccgatgaaatatctagagtatgcataaaaattttagaaaaaaagatgtttcgcttttatgatgatgctttaaatttgataggaataataagttttaaagggatatctactcaaaaccttgaaaaaataaagaatttgttgaaaggaatcattttagattctaatctagcaaaccagtgtcataacctcttatatgcaattataaatttaagaaaacagataatagcgggtacttcggaattaaatcaagttgtattaagtaacatgtctgaatcagatcgcaaaatttataatttagaaacatctagtgtcaaaagagaaagccatattatgagttatgttcaggagatcaaggaacaaattgagaaacaaggtaaaaatgggatttacagtgtgaaagcgcaaaacccatatctaataatccaaaatatcattaaagagggttgtgaaatagttgataactatctattaaatgaagttcttcaagtatgtaatgaatcgttatgtgcaactaatctactgtattctgataaggtgagtgctttacaattaactatttatattaaacagaatttccaaaatattgattataattttaaagatttatatcaatatttgattaaacacgaaaaccatctctttgaaggaaaagatgatctttttcaaaaatattcgacattaaccgtaaagattaattattttatgcttaaaatggtatgttgccaactagataatgttgatttattaaatctattaagtgaaattaataatgaggatgagtttgaaaaaatccaatgcttaaaggccattataaatgctataaataatgaatcatttaaaaatatagaatcagatattcgtagtatcattattcaattcactttaagtttgaagaatgacaaaaatcaagatatacggtatttatcaattaaagcattgctaaaaatgataacaaccaaaactcaaaaagttatactgactcagctttcacaatctatggattatgaaaatgtatatataaaaaatcttataataggaaactttgaaaaattagcaattatagattccaaagttaataatttaatattgaagaaagcttccatagataatcattatttggttaggacagaagcacaaaaatatatacagactagagcaattaatattactcaataaacttgtttagaaaaaaagagataataaatgtgaatcaaataatttactttcaaatttgaaaacaaattattaaggagtaaatacatgaaagaagaaatgattttaagaaaggtgatttattttttatcaacggcagaaacaccaagggaagtatttttagtatggaataagcacaaggaacatttaaaatactttaagttgagtataaacctagataattatgataaagatactttcccggttggattgggagaattggtaaatgcagttgatcaagactttatttcttactttcaaaccggaaagttatattacatggatgatgaattactgaatgatatgttatttaatggaagtatatcatttcctattgactattctgtgatgttagatactaattatgctagttatattcctcgctttttgaacaatcaagggagtagtgaatttgagaaagaaagtatttacaaaactatagatactctactaaaacataaatttcattatgattataatttctatttagtagaaaattataataaaattattaaagataatgggagttttgatgcttctataaaaaaacatagggatatgtacgagaatttagtatttttagagctatttaaaagcattgataatgatatatacataaataagaatattattgaataccaaatttcgaagtttgaggctatccaaagagtagacgatataatatataaattatataaaactagggatggtaaaagttcattaaagaagttcttagatatgcatcagaatttaacattacttctgatcggaattatcaaaatacagttcagttcaaaaaaaaatgcaaaaaataaaatgattaagttacttgaatatgtccaaaataaagtaggaatttattatgaaagagaaatggttattgcgcttaaatatttcaagaatcctaaatctgttgggatatttaataaaattaataaaggtggtaatcaaaaaaaattactcgaaaaaattgaaaacacagcttgggattttatggctccgagggtaatggaatatttctctaacttgaatagtgaaggaagatattttataccatttttcttatcccacgacaaaaacttgagagagcttttaactttatttgaaattaaaggggttttacaagatattagaacgggtcagttaataccattcacaaaaatctcaagtgctgagctctttaaaaatgaaggagtagaaatagatctttctttctattctcaggaatccacaaataaaagacgattaatatatgaaaagaatattaacgaaggttttagaattctgcaagatgaattctctgagttgaatgacataatgaattaattggagcctctctatattattttacatttaatttttatgttattttatatagcatgttaacagacctaggtataaaacgctggttttgttaatccctctgtgctgtataggcaataggataaacacattattattcctttgcggggaagttatataaatgcatttgctaaaagtgaatttaaagtgattattctactaaccgtacaagaaaataatacccatatcgcagtaaactgtgacggctaaatatttctagggagataaagccttgagtttaatcaatcggatgctcttatgtcaaaggaaaatactttttatataaagactcggtaaaccaagatcataagtcccgattatcttgtatagcaggccgatttgttgtcaatattcgatttactatgaaatcacttgttggcttatagtgaacaaaacaaaaaaaccagatccactaaaatctggttccccacagctgattagaagcaacctactgttgcttctctttcaccatctttataaagagaaagaagacaatgaatacaataaaataattcaatggattcttaacgatacttatctccagcgaaatctgtaagagtatccagagaatgaagatggctagtattgaaggaatgatgattttgtacatgtcgaccaccttccatagttagtaaaagaaaggggcgcgggccctttttttttcatgattaaaagcaagatgcggcagctcccgtcattgcaccgccaacagcgccggtaattgctccgacggcacccgctcctactgttccgatgccgggtattgtgactgttcctacagcagctcctgcaagacccagtgtgccgccgccagttaccgcaccgccgccagtacctagaatacatttcccgactgattgggtgctgattgacccgcttgtttttccagcgtctttgtttacgactttgactaaaacgccatttttgattttttcatatttcagtgtaacggggtcaccatttttgtcagtagagcttttcggaagagcctgctcctcgcccgttatgttgtcttttagggttgcattgcctttagcgtcaatatgaacatctgcatgattgaacgtcatcttcagctcactgtcgttgaggttttcaactttgtatgtagcttgggaacctgcggcagccgcagcatgaggtaaaaccgggagggcaaaggcacctgctaggaataccaaggctgccagtttcactgcggttagcttcattctgctttgcataattgatcctcctcctttggttgccatactaacaaaggcattctgcttgttaaagccttaccatataaaatgataaaaaattcacccaatttcatcacattaaccaacaaggtttgtatgtttcccttcgaaagtcataggagagcagggttcatatctgatgcgaagttatcaaggaggatagaaaccgtaaagaagagctcagagaagcacctttattgcgaacaacagcttcttccgcattttccacacgacagtataaatccctttccgtcacggaaacctagtggaaaaggtttctgaaaggagggggcgtatgatgaaaagtgaaaaaattcaaaacaaaacatctttggtttggaagatggcgattgcctctgcggtttcttgggaagcggcaaaactggcgggctctgatcacccctatttagcgcctctgtctgttatcttatgtttgcagccaacgatagatcagtcgattcgtttttcttttcatcgtattgcgggaactgcgattgggatcatgctaacgtcctttcttgtcagtcacttgccaatgaatggctggatgctggggctgttcctattaggcgggacttacattgcaaagtggttacgaatagatgtaacggttctgcatcaggtagcgctcaccattttattggtctttacgtttgaacgaaactctaaagattatgcattcgaccgaatcatcgatacggtgatcggcgtcatcatcgccattctgattcacatgttcctttttccgccggactacacaaaaaaggcagcggactcttttcaaacattggcccgtcagctttccgacgcactttcagacctttccaaatgggtgcaatcagagtggggacaaggaaaagggaaccttatggaatataaaatgaaccatcttctgcaggagctgcatacggcaaaagagatgctgcaaacagcctctgacagcttaaaattcaaccccgtcagaaaaaaacataaaaacatcatttcaagctatcaaatagagatgcaaaagttgaacgccggatttgagtatctgtcaaatatagtgaaaacgttaaaagaatgggaaaaagaaggagctttatcttcaagtgataaaagggagctggggaatgatttacaagtgttaagtgaatacttttcggatcttaaaggcatacagcagggtgaaacagacaatcggaaacagaaggaacagaacgtgttattggaatctctccgctccgacatgctgtcgcacccgccgcccggtcataaggtctataaagactctttttttttagaaacgaagaaattgctgaagcgtttgtaatgttttctggaaaaagagaatacggatatacagatatgatcaggtaaaagcgggggacatgagatggatgatatacaccggattttggatgtcatcgctaattctaagaaagctaaggtactggctaccatcattcaaacagaggggtccgcttataagaaagaaggggcttcgatgttgattttagaggataaaacaagagtcggaatgttatccgccggttgtctggaagaagatctcgttgaaagggcagaacaggtctggtctgcgggagaaccgttgattgtccgctttgatatgagtgcggaagacgatttatcctggggacagggcattggctgtaatggtgttttgacggtgttgcttgagcctgtaaaaggggaattggaacggcatctgatgacagtcaagacatgcttagatgaaaaaaagtctgtgacccgaatgaagcgattcactgaaacgttagagccgaaggaagatctgtatatcgctgaagacggcagcgtgtttggaaccggggatgtgatggaacaaggccgtattcaaaaactgagacagacggagaagggaatcaaaagggatgaacatacatctgatttgttttttatccatcagatggtgccaaaaccttgtttatatgtcttcggagcaggagaagatgcgaggccgttagtttcgttggcggctcgtgcgggctttcatgtgacggtgattgactggcgtcccgccttatgtcatcacggccattttcctgaagccggccatttgataacgggagcgcctgaagaagtcatgaaaggcctgagcatgacaaaaagggattttgttgtcattatgacgcacagctttcaaaaagatcagatcattttacatacattaaaaaacgagaatgtgttttataaaggcgtattaggccccagaaggcgtacggagcggcttttaggcgggggtgagattccggaagatatacattcccctatcggacttcccatcggggcacaaggccctgaagagattgctgtaagcattgtcggcgagatgattcaaaaaatgcgaaaacaaaggtctcgcctatgaaaacagcaggcatttacctggcagccggtacaagcagacgcatgggaacggataagcgaagtttatttctcaatggcgtttccctcggaagtatggctcttaaaaatgccttgttatctgaattagatcatatttttgttattacgagaaagggagattcactgcattggctttcggattttttctttttagatcccatgtcaaataagtggagccaggcagaatgtgagcaagcgggtaagggccaaggccattctatacaatgcggtttgcaaaaagcggcagcgtacgaggctgacgccgttatcattctccttgcagatcagccgtttgtcaccgcagatatcatcaatacgttaattgattcctatcaaaaagagcgccgttattcatttatcgccgctgaaaatcagcatcttcctatgccccccattttattctcaaatcaatgtttcccggtattgcatcagttaaagggagatcagggcgcccggcatgtgatccgtgaaagtatgatcaatatgggaaaaatgatcagctttcaagaccctttgcttttttatgacgtcgatacagttgaagattatacgctgctgctgaataaattcggggagtgaatgagttggagtatatcgggaagagtgtcattcggaaagaggcccttgaaaaagtgacgggtaaagcgaaatatacggatgattttcaagaaacagggacgttgcacgcaaaaatgctgaccagtccatatgctcatgccgatattgtgtcgatggacttttcagaagcttggaagattcccggcgtgagagcgatattgggggatgaaccttttccgcttgcaggtgaagaaattaaagacagatcgccgattgcttataaaagggtcagataccatggtgagccggttgctgttgttgttgcggaaaatccgattacagctaaaagggccgcggatgccatcaaagtatcctataaacctcttcccgtcgtcaattccccccgtgaggcctttcaaaaggatgcgccgctcgttcatgaacatgcggaccgctatgagaagacaaaaggtgtattcccggttccgaagacaaatatcgcaaacgtggataaggttagaaaaggaaatattgaagacggatttagggaaagtgatgtgacagcagaattccagatttcctttaacccttctgatcacgctgcgatggagacaagatgctcgatcgctgaaattcgggcggatgaggagattatcattaccacatcctctcaagccccttttgccattaaaaaattaatgcagtggtattttggaattgaacccggaaaggttatcgtcaaaacgcctttagtaggcggggcgtacgggggaaaagcagccgttcagttagaggtgattgcctatttggcatcaaaagcagtcggaggccggcccgtcaaattgtttaatacgagagaagaggatatgatcacatctcccgttcatgtaggattggatgccattgtcaaattaggggccacaaaggatggaattttaaaggcggcggacattcagcttttatttgatggcggagcatactctgataaaggagtggacatcagccgggctgcggtggttgattgtacgggtccgtacgctatcgaccatatatcgtgtgattcatattgtatgtatacgaatcatccatatccaagtgcattcagaggctacagccatgctgaagtgttatttgcttttgagcggacgatggatgtattggcggaaaagctgaacatggacccgttagaacttcgctataaaaatgccattcgccccggtgacaccacaccgactcaagttcttctcaattcaagcacggtcggaaatgtaccgaaatgtattgaaagattgaaggaattaatgaattgggacgagggacagcgaattgaaatcgacggccggaagatacgggcgaaggggatcagctgtatttggaaaacctcaacatttgatacaaatgcaacgtccggagtgattttaacctttaatcctgatggaagcattaatttgatgtcagggatagtggagattgggacagggacaaaaacagtgttagcccaaatcttagcggaacgaatgaaaatggatataagcaaaattcacgtaaaaatgcttgtagatacacaaacaacacccgagcattggaaaaccgtggggagcagagggacgttaatggccggaaaagccgtactgaatgcagcggaggaagccattcgaaagctgaaggacgcggcatcatgtgtgttgcgagttcctgtcgaggaattggaagtggccgacggaaaggtttattttatagatcatccttctgtacatgttgacataaaagacattgcttacggatatacgtttccgaatggaaataccattggcggccaaatcattgcgagcggcaattacacattaacccggatgacgaatttagaccgggaaacgggaagaggaaagccgggacccgaatgggctgtaggtgctcaggggattgaagttgagttggataaacgggattatacgtaccgaattacaaaagcctattctgttgtggatataggaacagtattgaatgaaaaagctgcaaggggtcaagtgatgggggggatgagtatgggaatcgcattcggaggaagagaaacctttgtatttgattcatatggcagagtattaaatcctcagcttagaacataccgcccccttcactatggagagcagcctgaatatatcattgaatttgttgaaaccccgcatgtgattgcgccttatggagcgcgcggcggcggggaacacggactgctggggatgccggccgcattgggaaattgcctttccgccgctttaggtgtccaattgaatcaacttcctctcattcccgaacaattatggaggacgcaagaggggtggaaagatgataccgtttgattttgattattttaaaccgaagaccattcaagaaacaatcaatctatttcactcgcttgcggccgaaaagaaaacaccaatgtattattccggcggcacggaaattatcacgttaggaaggctgaatatcatctatacggatgcggtgatagacatgaacgcgcttccgggatttcaaaccatccgcttttatgaacatgaactggtgatcggagcgggtgtgtcattaacgaaactggaggaagaaaatccatttccgctattaagtaaaacagtaagtgaaatagccgatcggacgactcgaaataagatcagcctgggcggaaacatttgcgggggcatctactaccgtgaggccgtgctgccgttgctgatttctgatagtttgctagggattgcagggagagcggggattcattaccatcctataaataaagtatttaacaaggaaatacaattgcaaaaaggtgattttttatttcatatcgttgtcgatcgagcgtatgttgacttgccatttgtcagtatcaaaagaagacagcagtggaatgtcggatatccattggtgacagtctgtgcgctgaaaaaagatgatgagatcagaatggctttcagcggcgtatgtccatttccgtttcgttctgctgaaatggaggctgtgcttaacgataaaagctattcattagaagatagagcgcgcaggtctttacagtatgtacccaaacccgttcttgatgatgcggaaggctcaagtgaataccgaatatttgtcttgcaacatacaattttagatgccttacgggaattagaaggaggtccaaatgtctgatcctattacgttgaaagtaaatggcgaggaaagacagatgacggtcagaccggctgatactttgttatttgctcttcgtcttcgtctcggattaactggtgcaaagccgggctgcttaaatggggattgcggcgcctgtacggtattaacggacggggtgccgatgaaatcttgcttaatgcttgcggcagaaggggaaggaaaggatattacgacaattgaaggactgatcaatacgccgattcaaaaggcctttattgaaaaattcgcgtttcaatgcggttattgcacaccgggttttctcatgaattgtcatgctttagtgaatactgagccgaatgcaagtgatgacacgattaaaaattggctggagtccaatatttgcagatgtaccggttatcgggagattgaagaagcggttaaatccgttttacgtatagggaaagggactcattagtccgtaaccgtaaaaaaaagagcccagagaatcatctctgaactccatattcttcacttcatataccgatactcccgcagtttctccaaaatcgccacttctttcatcagttcttcaccgacgtttgtttcttttactttcttccgctccagctctttgtcgactaatcgtttcactgttaagacgtcggttccggtgctcagcacttcggccttggagttaaagtgtttatgggcgacgagctgcataccgtatgagttgtataagagcgtgtagccggcgatgcctgttgtggattggtaggctttggagaagccgccgtcgatgacgatcatttttccgtttgccttgatcggatcttcgccttcgatttcttttaccggtgtatggccgttgatgatatggccgtgatccggattgaggccgaattccttcaggatgtttcggcaggttgcctcgtcttcacgcaaatagtaatacgggtttttcttttctttatgcgtttccttctctttaatgaaataccgctcaaaggttgtcatggcccgttttccgaagagggaggagtattcgcctgtccataagtaccacgtcatatctgtcgccagatcatcggtttcttccggatgggcaaacgcttcccgtaagaaccgttcaaatacatcgagcagctcacggcccgcataagctttatcctctatcatcatcgtttccatgctgccgttttcatcgacgggaatacagccgtgaatcaacaggttgccgttatatttcagatacaggctgccttttttcatcataaaattcatatggcggcccagcttttcggagtgctggacagaaaacagcagcttgtccatgacttctgcttcttcttctagcagctcgtcaggctgtttgggattcaccgtcgcaaagcaggtgttttccagttgatacgtttttccgttcagcgtgatttcattgcggtcataatcgatcttttccagtaacagccgttcttccatattaaagttcggccgtctcttaataatcgggctctcaagcttgaattggatcatcgcgatcgcctgatgaatttttgtgatttgtttaatctcatcttccggtctgttttcgtccgctttcgggcggaaagacgggttatcatcgtaatatttttcggcaaggttcaatagcggtctcagattgatgccgtaaacgtcttcaataatatccagattgtcatagcgggcacagatgcggataatatttgccaggcatacttttgagccggaataagcgcctatccagagaacatcatgattcccccattgaatatccactgaatgatagttgatcagttcttccatgattttatccggctgcggtccgcggtcgtaaatatcgccgaccacatgcagatggtcgaccaccaatcgctgcgtgctgtaggcaagaccggtgatcagcttatcggcctggccgagcgcaatgatctgttctatgatttcggagtagtattgttccttgttggcggcttgttctgttttgtacagcagctcttcggaaatataagcaaattgggcgggcagtgctttgcgcaatttggatcgggtgtacttggaagaacaataagaaacgagcttaatcatccgatgaatcgtttctttataccactcgtttaatgcctctttcgtatcaaagccatgtttgatcagcttcagtttgtcttccgggtaatagaccaaagccgccaattcatcaatttctctatcgtaaatgacgccgttgaaaatatcgcggatcttctcttttactcttcctgaaccgttccgcagcacgtgctggaatgcctggtactccccgtgcagatcactgacgaaatgctcggttcctttcggcaggttcagtatcgctttcagattaatgatttccgtgaccactttttcttcacaatcgtatttttgtgcgagcagatctaaatatttggtttccaatctcgtccatcccctttttatttacgagcaattgtatgataaagtgaatttaaagtatgacataatgtttaaatgattagaccttatatgatagtaccgcataacgcctttttgagacaatgaaaacggaagatacggcgcttcaggcatcaaaaattggaccgggataacgctgtgagcgtatacccctgttgacaatgcattcaacttccattaaaataaaaagttagctgatagttatttctatcggaaactcaatacgtagcaggctatgattgctgtgggtcgcactacagcaggagcggcttctggagagaccgcgggttttccgcggcgccgaagggttcacaatctcaggcaaaaggacagaagagtaccgaatatgtatttgtcatgctgttgattgtcagcggcgcaaatataatttgatattcttatgaccatgagattggagggcatccaatctctttttttattggctttttttgctcgtcgttcactagagaggtaaggaggagtcagatgtggagcagcgagagctaaagagggacttatcgaatcggcacgtgcagctgatcgctattggcggcacgatcggtaccggattgtttttagggtccggtaaggcgattcagctggcgggtccttctatcatctttgcgtattttattgtaggtattgcgctttttttcgtcatgagggcgctgggagaactgctgttatctaaagcggggtaccaatcattaacggatatagccgaggcgtatttagggccgcgtgcagcgtttgtcaccggctggacttattggttttgctggattatgacggctatggcggatgtgatcgccgtcggtgtgtatgtgaaatattggtttgatattccgcagtggattccggcacttatctgtttgctcattttattagggcttaatctgttaacggttaagatttttggagaattggagttttggttcgccttaattaaggtagtcacgattctcgcgttaattgtcatcggggtggttctgctggtgattgggttcaaaacgcataccggaacggtttcagcggcgaatctgtgggagcacggcggcttgttcccgaacggattttcaggctttttgctttcatttcagatggtgatcttcgcctatgtcggtgtggaattagtgggtgtgtcggcggcggaaacgtcaaatccgaaaaaaaatattccgtccgcgatcaataaaattccattgcggattttatttttctacgtcggggcattgatcattcttttatgtattaacccgtggatgcagctgaatgcaacggaaagtccttttgtaaagaccttcagtctggtcggcattccgttagccgcgggaatcattaattttgtcgtattaacgtctgccgcttctgcttgtaacagcgggatgttttcaacaagccggattctgtataacttaagcaaaacgaaacaggcgccggcaagttttgcgaagctgaataaaaatcatgtgccgagccgcgcgttatggatatcggttattgtgctgtcagcgggcgctcttttaagcaaattgataccggaagcggcctttggcatcgtgacaaccatcagcgcgatctgtttcatttgggtgtggggcgtgattcttgtctgtcatatcagatacaggaaaacccgtccggacttacacgcaagctcgtctttcaaggcgccgtttgcgccgtttatcaattacgccgtgctggcgctgtttgccttcattctggtgattatgctgtttgcggatgcgacgcgcccggctttgctgctgacgccgctgtggtttattggattgtttcttatctatcgggcgagagggagaaagacagattgaattacttcagacggtgtactgccatgcagtatgccgttttaatataaaaaaagcgctatcctgccgtgtaagcagggtagcgctttttacattaattccggatcaaataatcaaatgcgcctaaagcggcagttgcacctgatcccatggagataatgatttggttgtacgggccgtctgtgcagtcccctgcggcaaataggccgggaacgcttgtcgcgccgctcttatcgacgatgatttcgccgatgcggttgcgttcgacggtttcgtctaaccattctgtattaggcacgagaccgatttggacgaatacaccttggagttcaacgtgtttttcttcgcctgtttcacggtcaacgaacgtaatgccgtttacgttttggtcgcctgtgatttctttcgtttgtgcatttttgtgcacagtgacgttcggcaggctgtaaagacgtttttgcaggacttcgtctgctttcagttcaggcgcgaactccagcacagtcacgtgattgacgatacctgcaaggtcaatcgccgcttcgattccggagtttccgccgccgataacggctacgtctttgccttcaaataatggtccgtcacagtgcgggcagtatgcaacacctttgtttttgaactcttgctcaccaggtacgttgacattgcgccagcgggcacctgttgaaaggatcactgttttacttttcagtacagcgccgttttcaagttcaagttcgaagaggtcttttttctcaaggcgtttcgcgcgctgaaggttcatgacgtcaatatcataatctttcacgtgctcttcaaggcttgcagcgagcttcggtccttcagtcgctttgacgctgatgaagttttcgatgctcatggtgtcgagtacctggccgccgaagcgttcagcgacgacaccggtgcggatgcctttacgcgccgtgtagatcgccgcgcttgcgccggcaggtccgccgccgacaacaagaacgtcaaacggctctttgtcggcaaactcagacgcatctgcgccgctgcccattttcgcgagaatctcttcgatggtcatacggccgctgccgaaagattcaccgtttaagaaaacagtcggaacagccatgatgtttttgctttctacttcttctttgaatgccgcgccgtcaatcattgtatgtgtgatattcgggttgagcacactcatcatgtttaatgcttggacgacatcagggcaattgtggcacgtcaggctgatataagactcaaagcggtattctccgctgatgttcttaatctggtcaatgaccttttgatcagccttaggcgctctgccgctgacttgaagcaatgccagcactaatgatgtaaattcgtggccgagaggaacaccggcgaatgtaacgcctgtgtcttctccggtacgattaacgctgaagctcggtgttctgtttaattcagttttttcaactgaaattttagatgacatggaagccagttcgtcaacgagagccagcatgtccttagaagtgtcatcgtcaccggcgcttactttgagaacaatgtcgttctcaattagctgcatgtattgatttaattgtgctttgatatttgcatcaagtaccaatggaatgcactccttagattttacctaccaaatcaaggctaggtgtaagtgtttcgccgccttcttcccatttagccgggcagacttcacctgggttttgacgaacgtattgagctgcttttactttgtttactaggttgcttgcgtcacggccgataccgcctgcattgatttcaactgtttggataacgccatcaggatcgatgatgaatgttccgcggtcagcaagaccagtttcttcgtcaagaacgtcgaagttgcgggagatcgtttgagatgggtcaccgatcattgcgtaagtgattttgccgattttttcagagctgtcatgccagcctttgtgtacgaagtgagtatctgtagaaacagagtatacttcaacacctaattctttcagtgcagcgtattgtccttgaagatcttcaagttcagtcgggcaaacgaaagagaaatccgctgggtagaagcagaaaacgctccattgacctttcaaatcttcgtttgttacatcgatgaattcaccgtttttgaaagcttttgcttcgaatggcagtacttcttttccgattaaagacataatatcttcctcctgaaatgtgatttgaaatatattaaaaagacaaagcattcactttatctttcaataataattctaattatatatagattattaaataacatttattttttgtcaagctatatggggtattattttctgctttttttgctttagacgttaaaaaacgcctggtataagcggtttggcgctgtttgtcatgtttagcgccgggcgaaagggggattctcaattggtgaatcgaaacagtaggaatcaacccctctatatggcagtataaaccaaagggggtatgatcatgcaaataaatcacattactttgtacagttgtgcgttggaggagacgaaacacttctatgaacgggtgttaggttttcctttaattgatgagtccggggattcgtttaccatcaaggcgggagaaagtgagttggaattcaggcgcgccgattctcactctcaaccgacgtatcattttgcgtttaacattccgaataatcgttttgatgaggcgaaggcgtggataaaggataaagtcgtttttcaaacggaagatggggaggatgaggtgtatttctcccatattcaggcgcgttccttttattttaaagatccgtccaacaatctggcggaattcatcgcgagagacacatcgccgccaagcgcggaacgtttttcgattgagtccgttctgaatatcggtgaggtgaatctgacggctgccgaggtggtatcgacggggaaggagctgcagcgtctcggcattccggtgagaaagcatgcgcctcttagtgaaaacgggtttcattttatgggtgattacaatgatggggcgtttttgcttttagggccgagcggccgccgctggattttttctgatcagcatgcggagttccatccgctgtctgtcattgtgaacgggacgatccgcattgaggctgacggagaaggcggcattgacatcaggcgggcacagccgtcataaaaaagcccgggctcaaaaggcccggacttggggacattatttataaacaacccgggtgctgcacatgatgtcgtgcagcgtttttttctctccgaaggcacccatgatgaatccgatataaagaatgagcttggatatgatataggcgaaatgatataggcgaaagcgcgtccgaaggcctggccgatggaaatgcgtccgccatcttcattgacgaccttaaggccgagcaatgcttttcccagggtcccctgcatctttgaggctgtgagcaggctgaaatataagatgctgatcacaatagagctcacaagaatcggaatgacgccgaacaccagaaaagagatgttaaactgattttcggtcatgaaggggtcagccgccgcaacgcctgccgcaaataaaaaagagaccataaattgaatgataaaaatcggaattcctatgatgatttgatcaatgacgtaagccagaaaccgaatccaaaatcctgccggtctttccatgtatctttttctctcccttgctttaatctggaatattatacgtaatcattccggattttgcaatggagcttaagcttctgcgagcagcctctttccccatgccaagcgtcccatgatcagcccgaaagccagaagggcaaacatgatgccgcaccacatcagctgatggattcccaaatgtgaaataaaccagccgcccgccgccgttccgatggtgatgccgaggttggaaaaggagacaaacaggctgttgccgaattcgggcgcctcctttgcttccgcagtaagccatgtctggctgacaatgagaccgccggaatgaacggcgccccatacgaagacgaggacggccatcggcgcgaaagacgtcccaaacccgtatatgagcaagtaggcggctgtataaagaagcggaaacaggatgacggtctttttcatatttttatataacaaagcaccgaagacgaaattcccggctatcataatcaccccgaaactcatcagcatgaagctgacccatgtgccgatcatatgggacacccgcccgaggtactccgcaaaatagctgtagacagaaaacatggccgcaaagagacaggtgacggcagcgatattgagccacaaagccggtttgcgaagaatgccgagctggcttctgaaagacattttttctgtgaccggcatggatggcaaaaagagaagaatgcccgtgaacgcgatgagactgatgatagcgccgaataagaaggcggcttcaagagagagacgatccgccagataagacgtgaaaggcacgccgaacgcaaagccggcggtgatgcctgaaaagactttcgttacggcttttccggattggccggcggggacaagccgggccgcggccgcaagcgctacagaaaagaacaccgggtggcataaagccggaatgatccgaaacgccagcatgacactgaaatgcgccgtatacgcgtagaccgcatttgaaacggcaaacatcagcaccgctaaaagcagaatgtatttccggtttatacctgaagcaagcaaggtcaaaaacggtcccgacacagcgacgatgaacgcgaaaatactgacaagccaccccgcttttgaagcagaaatatgaaatctgtccgccacttgcggaagaacgccgataatgcccatctcggtcgtgataatcccgaaaacccctagtgccaaaaatagaatgaagatggagctgctttttttcattgttatgtatgcctccttttatttaactacatatatagaaaaatagatatgttagaacaaaaaaatccctcctttcatggttatagctggtgctggacatagtcagcaaaggctttaatttgtttttcatttcttctgtaataggtccactttccgattcgttcggattccagcaggccggctttttgcatcgtcagcaggtagctggagatgacggactgcgcaagccctgactttgcctgaatatcaccgacgcaaattccggtgcggaaactgagtccctgatcaagataaggtctttcatcaaaatggtcttccgggtgtttaagccacgtcataatatcacttcgtgttttgttagataacgctttatgaatcaatatcggttccataacgtttattatatctatttttctggatttgtaaattcgtttttgacaaaacattctcaaattaagtaaatatcgtgctaaaatataacatattatcagattaccggtaaaaaagccgggttattgtcaggaggatattcacatgaatcaaaagaaaaaaggtgcggttgcggtgaccttgctttccgctctgatgttttgtttattgccggtcctcgtctcgctttctccgcttgcagaaacggggccgaacgcgaatcgttttaattccgcgggcatgtgggccgccgtcggtcagatccttgttatatatgcggtcccgctcattatgtatattctcggtgttcgtggcatgaaaatcatcatggctgttttttgcgggatcgggcttatcatttgcgcggctgtcttgttggtggcgttattgaccgcaatttccttagggcaggagctgtctctttattacggtcttttcgtttggtcaggcgcggctttcatcgtcaatgtggtgtggtatattgccgcgtttcgatcatccccgaagcatcagcaggctatgtgacatttgttctataaatctaccgaaaatacaaatatttcataggatgattatggtatgatgaaagcggtatagcagtttttaatagaaacgggaggaactgacattgaaaaaaaagacagcttcattgcgaatgaaaacattggcggccggcgctgcggttgctgcggctttatctgtgggggcggtttctgatctgccgggggcaaaatggctgcatccggcggctgctcaagccgcggaaacggtatttaaacaaaatcatgcggcatccggtttcttggcgggacggtatgacgcgcaggcgatgtctccgacgatgttcaactggtcaagggaaagccggtttacaagcactgccgatggcgcgttaaaatgggaaaagaatgttccggccacccctcaaaacggtgcgggagccgcggttgacggggacggcacagtatttattcaatcaaaagacgggaagctgacggcgtatcatccggacggtactgtgaaatgggtgacggaaaacctcgggacgacctatacgctgactccggtgctcggaacaaacggtgtcatttatcttccttctcacgataaaaaactgtatttcatcgacaaagaaaccggaaacattttaacatcggttccgctgagcggagcgccgagttccgatgcggctatcggctctgacggcacgctgtatgtgtcgacgctggataactatatctatgcgattaaaccgacgtcgccatcgacatggacgcaaaagtggaaatttaaaacaaacggcgtggtcggctccgctcccgtgttagcatcaaacggcactctgtatacggcaacgtacaataatatcttttacgcgatcaattccggaacgggccaagtgaaatggtcaaaaacgacgtccaacgggtttaaaggttatccggttattgatagagacggcaccgtttacgccggaaaccaggacggcaacttatacgcctatacatcaacgggtgctgtaaagtggacgttcccgttaaacggtttctccagctcttcattagcgatcgaccataacggcaatgtgtatatcggttcgggaagcggcgagctgttttccatcagcaaaaccggtaatatgaactggtctttctatacggacgggcctgtgagaacggcgccgctgattgatgcggacggcaatgtgtacttcggttctgacgataaaaacgtctatgcggttgacgctgaggggaatgaaaaatggcgctatcaaacagacagcaatgtcatttcctccccggttctggctgaagacggcacgctctacgtcggcacttatacgaaactgctcgcattcggggcaaaaaaataataaaaaagaatccgcgcacgcggattcttttttttatttagaggcttgaatgaatacgcctttttcatgagagaattctttaaaaccgtacacaccgtgatatgaaccgatcccgctcgtattgacaccgccgaacggaaggttgacgtcagtgaaatgaacgacgacatcattgacagaagcattgccggacgtcgtatgctgcagaacataatcgatcagctcctgattatggctgaatacatacaaggcaagcggcttgtcccgttcagtgatgtaatcaacggcttcactgatatcttcgtaattcataatcggcagaatcggtgcgaagatttcttcctgcatgatcttcatatcaggcgtgacgtttgtcagcacggtcggagaaatcgtgcggtcatgagcatcgaatacgccgccgaacgccgtttttgcccctttttcaatggcatcatcatacagggctttgacacggttaaagttgcggtcattgacaatctgcgtgaatttgttgcggtcaaccgtatgatcatcctccataaaacctgcattgacaatggtctgcaggagatctgtaaaggtgtcctgtacatcttccttcataaggagatagtcaggggcgatacatgtttgccccgcattgacaaatttgccgacggcgatttttttcgccgcgtccatcaaatcatagccgctgtcgatgatcgtcgggctctttccgccaagctcaagcgtgacggacgacaaatgcttcgccgctgccgtcatgacgattttaccgacattcgtgcttccggtgaagaaaatgtggtcaaacggctggtcgagcagttctgtcgcgacatcgacctcaccttcaaaaatggcgacttcttcttcgtgaaatgcctcgcgaataactgtcgcggcgatatggctcgtctccatcgtaaaatcggacagcttcacaatcgcgctgtttcccgccgcaatggcagccgcaagcggagccatcgtcagcataaacggataattccatgggccgagaattaaggtaaggccttttggctcgtacattaatacgccgtcagcgtcggggctgacggatgagccgacgcgtttcggcgccatccaggtgtcgagattgttcatattatctttaatcgccttgatcgttccctgcgtttccgctcttttcacctcatgataaggcttgcggacgtcccgtctgatcgcctcgatgatttcttcttcatgtgcggtgacggcatctaaaaagcgctgaagcttttctctgcgctgcccggctgttgaagcacgcagcgttttttgattttttttctgaagcgcaaagacgcgtttgatgtctgcttttatatgctgatccatcggttttcctcctctggttgcttttttatttcttcagggcctattataatgtgatgtgtttttgcggcaaagacagcgtaaacgcatctatacgttaccgtacaaattgccgtgatctgtctaatgaaaggagtgtctcttatgccggattctatgacaaatgacatcaaacaagcgcttttggccatgcttggagagcgggatatccgccgtgtgaccatgaaggacatcgccgaacgggcgcacgtgagccgggggacactgtacctttattacgaagataaatatgcgattttagaggatatagaggaagaaatgaaagacgggctgagcgaagcgctgtatgattcgctgaagaataaagatgtgcttcatttacagggcggatggcaaaaagtgcatccgacactgtcttttgttgaccggcaccgggtgttttttcaaacgatgatggaccgtcataaaatgccgtattttcacgttcatgcttttttaaaagatgtgttccggcatgatgtgctgctgtcaccggtcaatgcggatttctcaccgactgaacaggatatgtacattcattaccgcgcgttatacacatatgccattgtgttgtactggctgaatgaggagcccggggcatccccggaagaaatcagcggacaggtgtgggatttgatttctcaaaaacggttttactggctgtttggccgccgggtgccggaacaagaagaaaaaaagcccgccgaccgccgggtgacaaggacgaggcaggccttgcaagaagccatgatcggcttaatggcggaaacaaaagagtacgcggcgatcacgatttccgatattgcccgtcaaagcaacctccgccgtgccactttttatgaccattacgccaacaaagaagcattgctgaaaacgatcatccatcaatcatgccgggatctgatcggattattgacggtaaaaggagatcctgccgactgttccgtggaagaagcggaagccgcgctcgtccggctcttttcggcgctgtccggcggccttccgctcgttcattttctgagagagggttcaggagtgcctgacgtcatcccggaaatgttcagagcgctgcaatcgttttatcttcatcagcctctgcacattcaggcgggcaaaaagctctatgcatactatgtcgcgtccatgctcgtcggtctgattcaatatcgtcttcatgaaggaaaagaccacgcgccggatatgctggcccgggagtttctgcagtttttggatgtgaagaagtatcgggtgattttgctgtgaggatgatgaaaaagaactcggccgaaaacaggccgggttcttttttgctgttttctttgagaagtgcagatatgaaagaaaccttccatatgacgcctgattagcattctgccgccaaacatgacaaatgtcatattcggggcatgatggctgctactacaaccgcgtcgggcgccccgttatacttgaggtcataatgaaaaagaagggacatgacattcatgatcaatcacgccgcaactcaaaaacaagcgtctttaaaaaagcaggttgccgcattttccggcgccgatacaaagcatagtatcattcagcttttcaacacgtttgtgccgttttttgccctttggtttcttgcttacttcagcctcaatgtctcctatcttctgaccctcgcctgtactgttatagcagcgggatttttgacaagaatctttattattttccacgactgctgccaccaatcctttttcaaacaaaagaagctgaaccggctgttcgggtttatttcaggtgtgctgacactgtttccgttccttcaatggcagcgaagccactccattcatcatgcgacaagcagcaacttagataaacggggcaccggcgatatttggatgatgaccgtcaaggaatataacgaagcgtcagcctggacaaaaatacgctacagactttatcgcaatccgtttattatgtttattctcggcccgatttacgtatttctgattaaaaaccgtttcaatgtaaaaggcgcccgccgcaaggagcgctggaacacctatttcacgaacgcggcgattgtcttattggctgctgcgacgtgcttgcttctcggctgggaaaactttttgcttgttcagggtccgattttccttatttcggggtcaatcggcgtctggctcttttatgttcagcacacgtttgaggattcttattttgaagccgatgagcattgggattatgtgcaggccgcggtagaaggaagctccttttacaagctgccgaagcttttgcaatggctgacgggcaatatcggctatcatcatgtccaccacttaagtccgaaggtgccgaactacaagctggaagccgctcatgagggacacgagcctttaaaaaacgtaccgaccattacgcttaaaacaagtcttgaatccatgaaattccgtctgtgggatgaggacgaaaagcagtttgtcaccttccgggaggcgcggaaaacatcggcgccccatccggtgccgaaagaacctttaaagaaaaatgcctgatacggcgcacggctctttctcttatcagaaagagccttctcttcatgcgtgagggtgcaatgaaggcggtgttttgataaagtgatggtagacacaagcagcagaaggtggaacaaagatgaagaagtattttaaatttcaaaaactgaacgggatttctccttatatatggacgatttttttcatcctgcctttttattttatttttaaaagctcttctaccttcgtcatcgtggccggcatcattttcacgctcgttttctttggcgcataccgctttgcatttgttgcaaaaggctggccgctttacttatgggcgcttcttctgatcggcatttcgaccggctcagccatgctgttcagttatatttatttcgccttctttattgcctacttcatcggccatatccgagacaaagttccattttacatcttatattacattcatatcatcagtgcggcggttgccgtcaacttcagccttgttctgaaaaaagaatggtttttgacacaaattccgtttatcgtcattacactgatcagtgccatcctgcttccgctcagcattcgaagcagaaaggcacgggagcgccttgaggagaaattagaatatgcaaatgagcgaattgccgatcttgtgaagctggaagaaaggcagcgcatcgcccgggaccttcacgatacacttggacaaaagctctccttaatcggactgaaaagcgaccttgcccgaaagctgatatataaggaccctgaacaggcccgcgctgagctgaaaagcgtgcagcagacggcccgcacttccttaaatgaggtcagacaaatcgtctcatcgatgaaaggcatccgattgaaggatgagctcggcaatgttcggcaaattcttgaagcggcaggaattgaatttgtgtatgaagaaaaagaagcgcccaaacatatctctttgctgaacgaaaacatcgtcagcatgtgcattaaagaagccgtcaccaatgtcgtgaaacacagcggcgccaaagtatgccgcatcaccattcagcagctttggaaagaggttgtcattacggtagaagatgacggaagctttcaatgcagagaagaccgctttttttcaaaggggcacggcctgcttggaatgagggaacgtcttgaattcgcaaacggcagtttagccatcgatacagccgccggaacaaagctgaccatgagaatcccgaatgattcaaaatcaaaagaaaaggatggtagcagatgatcaacatcttcattgccgaggatcagcaaatgctgctcggcgcactcggttcgctgttgaatttagaagaggatatgacggttgtcggcaaaggcacaagcggccaggatgccatcgatttcgtggaaaaacatgcgcccgacatctgtctgatggatatcgaaatgcccgggaaatcaggtcttgaagcggcagaagaactcaaggacagcggtgtgaaaatcatcattttgacgacctttgcccgctccggctattttcagcgggcgctaaaagcaggcgtcagcgggtacatgctcaaggacagcccgagcgatgagctcgtcagcgccatccgcagcgtcatgaaagggagacgcgtctatgcacctgaattaatggaggacatttatagtgaagaaaacccgctgaccgaacgggaaaaagaggtgctcgagcttgtcgcagacggaaaaaacacgaaagaaatcgcaaacgccctcagcatcaaaagcggcacagtccgcaattacgtttcgatgattctggataaactagaagtgaaaaatcgaattgaagccattacccgatcaaaggaaaagggctggtttaagtaacccgccctcagcttgttcagccagtgttttttttacactggctttttttattatctatcgtcactccgtctcttccttccacttcttatcaatcagcattttccccggccaagtgtatgccatgatgccgccgtctgcggtgatgtcttctcccgtgacgtaagagctgtcgtctgaagcgaggaagagcgcgacagccgccatttcttccggttttccgagccggccgagcggcgtgatccatttgttggcttcacggaacgcctcgcccatttcgtcttctttcgtgcctgccaatttatcaatgagcggcgtttcaattgtacccggcgataaggaattgacgcggattccgcttctggcgtaatcaatggccatcgctctcgtcaggttcgtgattccgccttttgcggcgttatagccggaacggtcaaggtctgcggcccggccggacatggaggaggtgttgatgatggagcctcctttttcgagcatgagcggaatcaggtatttgctgcacagaaatgtgccgcgcagatcgacggcgatgatccggtcaaacaggtcgaccgggtattcatggacattgccgccctcttggtcaacaccggcattgttaaacagaatatcaattgttccgtacttttgctgaatgccgtctgcaaaagactttacgttttcttcatctgatacatcaaggtgaaaggcttctgcttctccgccgttttttctgatggcgctgacggtttcattcagttcgctttcattgatgtcaccgcagatcacgcgggcgccttcatcggcgaaaacccgtgccgtcgcttgtccgatgcctgtcgcggcccctgtgatgattgcggttttgtctgttaatcttcccatattgcgattcctcctttttctatacctgttcccgctgaatagggggataaacatacggaggtttgtttctaattacctattaaatatgttaatattatgtatatacatcattgggaggtttacatattttgaagatacagcataagaaggagatagcgttttattgttatgccattgttcctatgggatttgtgatctacaccgttatctctattctgtttcaggacatcacgtttcctctcactgtaagaaatgttctgcatgagtctttgcgaaacttgggatctcttatcttatttagtttgtttttctacccgtcatacatatggatgaagaaggaattcggccgccggaaagaagcagagaggagaggatgatcaacattctctcttttttattgataaaatgggtgaaatgaatccattaacatgttaaatttacaatatatgcatctgctaatcctagttgacaattgtcactgtatatgataaatagatgctgaaaagattttacataacatcaaagcataattaaaggagagatctgaagtgcggaaaaaaaagtttaaagcagaatccaagcgattgctggacatgatgattaactccatttacacgcagaaggaaatttttctccgcgagttaatttccaacgcgagcgatgcgattgacaaaatctattacaaggcgttaaccgatgattcattaacgtttgatcaagacaattactatataaaagtgacggcggacaaagaagcgagaacgcttaccgtcacagataccggtatcgggatgacaaaagacgagcttgaacagaatctcggcacgattgcgaaaagcggttcactcgctttcaagcaagaaaatgactcgaaagacggccatgacattatcggccagttcggcgtcgggttttatgcggcgtttatggtggctgataaagtcacggtgaaaagtaaggcgctcggcagtgacgaggcgtatgtatgggagtcggaaggggccgccggctacacgatcgcgccgtgtgacaaggaaaccgtcggtacggaaatcaccctgaaaataaaagaaaacacagaagatgaaagctatgatgagtttttagaaaactaccgcatcaaagcgatcgtgaaaaagtactctgattttatccgctacccgatcaaaatggaagagacggtcaacaagccgaaagagggcagcgagaacgaatttgaagaagttcaggaagaacagacggtcaacagcatggttccgatctggagaaaaaacaaaagcgagctgacggatgaggattacgaggctttttacgccgagaagcattacggttttgataaaccgctgacccacgtgcatatcagcgtcgatggagcggtgcgctacaattcgattttgtttattccggaaaacatgccgtttgactattatacgaaggaattcgaaaaaggattggagctgtattccaacggcgtgctgatcatgaacaaatgcgccgacctgcttccggatcatttcagctttgtaaaaggcatggtggattctgaggatctgtcgctgaacatttccagagagatgctgcagcacgaccgccagctgaagctgattgcgaaaaacatcaataaaaaaatcaaagccgagctgaagagcttgctgaagaacaaaagggaaaaatacgaatctttctatgaatctttcggcagacagctgaaattcggcgtctataatgatttcggcgcgaataaagacgtcttaaaagatctgcttctcttctattcatctaaggagaaaaagctcgtcactctggacgaatatgtgtccagaatgcctgaggatcaaaaatatatctattacgcgtccggcgattcatatgagcggattgaaaagctgccgcaaactgaaatggtggcggacaaaggctacgaaattttatatttcacggaagatattgatgaattcgcgatcaaaatgctgacaagctacgaggaaaaagagttcaaatccgtctcaagcgccgacttaggcatcgacagtgacgaagatgataagcagactgaagccgaagaaaacgaatataaagacctgttcgaaagcatgaaagagattcttgcggataaagtcaagaatgtcagagcctcaaaacgcttaaaatctcatccggtctgctttgcgacagacggcgaagtgacgatcgaaatggagaaagtgttaaacgccatgcctgacagccagcaggtcaaagcggaaaaagtgctggaaatcaacccgaatcacgaagtgtttgagacgttaaagaacgcgcacggacaagatcgggaaaagcttgctttatacacaaacctgctgtacaatcaggcgcttctgattgaagggctgccgatccatgatccggtcgagtttacgaatgatatctgcaaagtcatggtatgacgccaaaaaggaatcgcccagcggggcgattccttttttgattacagtgtgcgctgtttaagaatttgattttgtttgctgcgcttctttaaggagaaccgttttttcaagtgcgtttcgatttcttctaaacttttgcccttcgtttcaggaacgatgtaagcggcaaagaagaaggatgtaaggcagatgactgagaatattccgaacacccagccgatgcccattgcgctcagcataagcggaaataccagcgaaacgatcaggttggttgccgacagaatcaatgtcgtaaatccggttgcggctccgcgtgcgtttgacgggaacagctccggcatcagaacccatacgacgggaccccatgtcgcctgataaaagacgatatagattccgagaaacagcacggtcagccaagctgttgaagctgacaggccggccagaaggagaatggctgatagtgacgccaggctcaaggtaatgccgacacttccccacatcagcagttttttccggccgatccggtcaattaagatcatggcggtgatacacatgatgacgtttaagacaccgatgcccatcgtgccgagaacggacgccgaagtgccgagtccggcctttgtaaagatggtcggcgcatagtaaatcaccgtgttgataccgaccgcctgctggaagatggcgaggccgatcccgatcagcagcataggacggatccattttgctttcagcaagccgagcgtagattcttttttctcggcttctccttgtttcatttccgccaattcaacggcgatatcctctttgtcgtgagtcatttccatgacttgtctggcttcctgctcacggccgcgtttgacgagccatctcggagattccggcataaacgcgattccgattaataaaagcgccgccggtactgccgcgagaccgaccatccagcgccaagcttcaaacggggtgaatatgtaattcacaatatatgcgagtaaaattccggttacaatcattaagttattcaatgtgccgagcgttccgcgtatttttgtcggcgccatctcagatagataaacgggaaccagcgccgttgagcctccgacggctaacccgagtatgacacgggagataatcagcatggtgacggtttgcgaagccgcacaggcaagcgcgccgataataaaaatgagtgaaaggacgaaaaccacttttctccggccccatcggtcagagcatgtcccgcttaaggcggacccgaaaatcgcaccgagcagcagcatgctgacgaccaatccctcggtcagcgtgtttaaaggaatatcattgttaataaataacaaagcccctgaaatcacaccggtgtcatagccgtaaagcagcccgcccaatgctccgaaaaagtaaatcaggtattttttggtgtttttcttcacagatgatcctcctcatcttttggaacgcataatagtttatttagataactatttcattccccgaagagaaaaatataaacataaaaaaacacgccctttcaaaaaggcgtgttatttttcttaggaaaacagcttgtcaataaacgcgatttcttcagcagatagcgtaatggaggctgctttcatgttgtcttttaattgatccgcgcgtttggcgcccggaatcaggatatcgatttcaggtctcgccaagtaccaggcaagcacgatatgcgccgtatcggcattgtgcttttcagcaatcggtttgagctggttgacttttttgatgttttctttaaactgctccccttggaaatgcgcctgatcattgcgcaggtcgccttccgggaaggttgtgttctcgtcgtatttgccggccagcagtccggatacgagcgggaagtacggaatgaatgagatgccgtgttctgtcgtataagggaagaaagtcttttccgcctcacggttcagcaggttgtattctccttgaatcacgtcgactaagccgtctttattagcttctttcagctgctccaaagagaaattggatacgccgatggaacggatttttccttcttttttcagctcattcaatgcttgaacggcttcgtccttcggtgtatgctcatccgggaaatggatgtagaataaatcgatgtaatccgtctgcagccgtttcaggctgtcttcaaccgattgtttcaaaaaggccggtgagttgtcgaaaacaaagtcattgccttcttttctatgagcggcttttgtggcgatgaagacatcctcgcggttatattctttcagcacctcgccgatcaattcttcagaacggcccacaccgtaaatataggcggtatctaacatggtaacgccgcttttaatcgcttcccggaccaattcttttcccgtttcttcattcagattcggatagagattgtgtccgccgaccgcatttgttcccaaaccgatcggaaatacctttaggtcagttttgccgattgttactttgctcatgttttcgccccctgaaaaaattggatatcatagcgcctgccgggaaaatacggcagcgttctctattaactataacgctatgccaagtgaatgtcgatttggtgctcttggcaatacttcgtatattcctcatcgagctgctgagaagtgacgatgctgtgaagccggtcaaaaggcgcgtatgtcaaaagcgtggatttgccgaatttggaatgatccgcgagcagatacacttcgttcgccttttcggaaattttctttttcacctcgtattccagtaagtcggaattcgtcaggccgtgggtgatcgttgtcccggtagcggacatgaacgccttgttaatgttgtatttattgagtgtgcccggatcatcaatgccgacaaacgaccttgtcttccgtttgtagttattgccgatgatgatcaggtcgatatttttcatggatgaagcggcgttaataatatcaaggctgttcgtcaacaccgttacattcttatccgggtcaagcgtctccagcatcgatttggtcgtcgtgccggaatcaataaatacaagatcgtgatcctcgataaaccgcgacgcatagcgggcgattttgattttttcatcctgatgttgaatggtgcggttctcaaaagggacgagcacagatttttctgctgacgtcacgccgccgtacacctttttgatcacccctttttccgcaagcttattaatatcgcgtctgaccgtgtttttagagacgttgaatacctcgcacagctcatccagcgaagtggctccgtgtttgagaatgtattcttccatctcctgaatccgcatcagtttcataaaaaaactccttctagaattcttaaagtaattaaaatatataataaacaccaagagttaatcaatagttacttaacaaatgataaaaaagagggttcccaccgtacgattcgacacggttctccaagttcctgttttcccgcttaaaaaaagtatgataaaaataatgaaaaaattttgattttttagattgacttgaaggtgtgttgggcttacaatgtaaccaagaaatgaccaaaatataacctgtaaaatcaaaagtgaaagatgtaaccgtttgctttatccggcacatgaccaacttttacatgaaaagattgggagtcaccatcattttagcatttgtaagcgtttaattcatgtcttttatatgtaaaagatgaatatattcatccgttattatccagctgaacaggatgtttactatttaaggaggcaatgagaatggcagagatcagaaaactgaaaaactacatcaatggtgaatgggttgaaagtaagacagatcaatatgaagacgttgtcaatccggctacaaaagaagtgatgtgccaggttccgatttctacgcgggaggatgtggaatacgccgtccgctcagcgtcagaagcgtttaaaacatggtcgaagacggcagtgccgcgccgtgcgagaattctatttaactatcagcagcttctccagcagaacaaagaagagcttgcccgtctgatcactttggaaaacggtaaaaacacgacagaagcactcggtgaagtgggacgcggaattgaaaacgtcgaattcgcagcaggcgcgccgtcactcatgatgggcgattcacttgcctctatcgccacagatgtagaggcggcgaattaccgctatccgatcggggtggtcggcggcatcgcaccgttcaacttcccgatgatggtcccgtgctggatgtttccgatggcgatttcgttaggaaacactttcattctgaagccttctgagcgcacgccgctgttaacggaaaaactggcagagctgtttgaacaggccggtctgccgaagggcgtcttcaatgtcgtgcacggcgcgcatgacgtcgtaaacggcattcttgagcatccggagattaaagccatctcattcgtcggttcaaaacctgtcggcgagtatgttttcaaaaaaggcagcgaacatttgaaacgcgtgcaggcgttaacgggcgcgaaaaaccatacgatcgtgttaaatgacgcccaccttgaagatacggtcacaaacattatcggcgcggcattcggttcggcaggagagcgctgcatggcatgcgcggttgtgacggttgaagagggaatcgccgatgagtttatggcgaaattacaggaaaaggccgcagacatcaagatcggaaacggactggatgacggcgtgttcttgggcccggtcatccgcgaggacaacaaaaaccgcacgcacagctatattgaaaaaggcatcgaagaaggagcgaaactgctttgtgacggccgtgaacatgtaacggaagacggctatttcgtcggaccgacgatttttgacaacgtgacgacggatatgacgatctggaaagatgagatctttgcgcctgttctgtcggtcatgcgtgtgaaaaatttaaaagaagcggttgacatcgccaaccagtctgaatttgcgaacggcgcctgcctgttcacgtcaaatgcgaacgcgatccgctacttccgtgagaatattgacgcgggaatgctcgggatcaaccttggcgtcccggcgccgatggcattcttcccgttctcgggctggaagtcttctttcttcggcacattgcacgcaaacggaaaagacagcgtcgacttctatacacgtaaaaaagtcgtgacggcacgatacccgtctcctgacttcaattgatcagacagccggcccggacggctttgtgattccgtccgggttttcttttaccatccattaaggaggaataaacatgagtcatttgctgcgcaaaccgcaggccgatgaaatttctcaaggcgtgaccatcatacatgacgtcacttcagccaattcagacctcaaatacgtcggatttaaagtcgttgatctcgctcccggctcaacctatacagaagatttgaaaaagacggagtgctgcatcgttgcggtaactggaaaagttaccgtcactgattatgatcagacatttgaaagcatcggcacccgtgaaagcgtatttgatagaaaaccgacggacagcgtttatgtgtccaatgaccgctcttttggaatcacagccgtcagcggggcgagggtcgcgctgtgctactctccgtccgaacaccagcttccgacaaagctgattaaagcggaagacaacggtgtggaacatcgcggcaagctggcaaacaaacgaaccgttcataacattctccccgattcagatccatcggcaaacagccttctcgttgttgaagtttacacggacagcggcaactggtcgagctacccgcctcataaacatgaccaagacaatctgccggctgaatcatttttagaagaaacctattaccatgaaacggacccgccgcagggatttgtcttccagcgtgtgtacacggacgaccgctcgattgacgagacgatgaccgcagaaaatgaaaacgttgtcatcgtgccggcgggctatcacccggttggtgttccggacgggtatacctcttactacatgaatgtaatggcgggaccgacacgaaaatggaagtttcataatgatccggcccatgaatggattctggaacgctgacaagtgaggagtggcagataacgatgaaatatacgtttaatgaagaaaaagagtttgatattgtcgcgatcggacgcgcgtgtattgatttgaacgcggcggaatacaaccggccgatggaagaaacgatgacgttttctaaatatgtcggcggctccccggcaaatattgcgatcggcagcgctaagctcggattaaaagccggttttatcggcaaaatcccggatgaccagcacggcagatttatcgtttcttatatgcaggaaaagggcgtcgatacgtcacaaatgaccgttgacagagaaggacgcaaagccgggctcgcttttacggaaattctcagtcctgaagagtgcagcattctgatgtaccgggatgacgtggcggatttgtatctagagccgtccgaagtcaatgaaggctacatcgcaaacgcgaaaatgctgctcgtatcaggtacggcgcttgcgaaaagcccgtcgcgcgaagccgtcttaaaagcggtgcaaatcgcaaaaaaacatgacgtaaaagtcgtgtttgagctcgactaccgtccgtatacatggcaatcggcagaagaaacagccgtgtactacacgctggcggcggaacaatccgatatcgtcatcggtacgcgtgacgaatttgacgtaatggaaaaccgcagcggcggaaataacgatgaaaccgtccgccatttgtttgcgcactccgccgaccttgtcgtcattaagcacggcgttgacggatcatacgcatacagcagatcgggagaagttttccgggcgcacgcctataaaacaaaggtgctgaagaccttcggagcgggtgattcctatgcgtcagctttcatctacggactggtcagcggccgggatattgaaacgtcgttaaaatacgggagcgcttccgcttccatcgtcgtcagcaaacacagctcctcagaagcaatgccggctgccggtgaaatcatcgaactgattgaagcgcagcacagtcttaacggtaaatagaacgtataaaaggtgggatcgtttgtgggtaagacaattcgcttaacgacagcacaagcgctgattcaattcttgaaccggcagtacattcatgttgacggaaaagaagagccgttcgttgagggcatcttcacgattttcggccatggaaatgtgttggggatcgggcaggcgctcgagcaggacgccgggcacctgaaagtctatcaaggcaaaaacgaacaaggcatggcgcatgccgcgatggcatacagcaagcagatgctgagaagaaaaatttacgcggtatcgacatcggtcggtccgggtgccgctaacttgacggctgccgcgggtacggcgctggccaatcatatcccggtgctgctgcttccggccgatacctttgcgacgaggcagcctgacccggtgcttcagcaggtggagcaggaatacagcgccgccgtcacgacaaacgatgcgttaaagcccgtgtcccgctattgggaccgcatcacccgccccgagcagctgatgagcagcttaatccgggcatttgaagtgatgacagatccggcaaaagcgggcccggcgaccatctgcatttctcaggatgtagagggagaagcatttgattttgatgaaagcttctttgaaaaacgtgttcattacattgatcggatgcagccgagcgagcgtgagctgaaaggcgccgcggagagaattaaggagagcagccgtcccgtcattttagtgggcggcggcgcgaagtactccggcgcgcgtgaggaattaatcgcgctttctgaaacatacggcattccgcttgtcgaaacgcaggccggcaagtcaacggttgaagccgattttgccaacaatctgggcggcatgggcatcacgggcacacttgccgcaaacaaagccgcccgccaggctgatctgatcatcggtgtcggcacacggtacacggactttgcgacatcctcgaaaacggcgtttgattttgacaaagcaaaatttttgaatatcaatgtcagccgcatgcaggcatacaaacttgacgcgtttcaggtcgtagccgatgcgaaagtgacgctcggcaggctgcacggcttattagacggatataaaagtgcattcggcacggcgattaaaggctggaaagatgaatggctggctgaacgggaccggctcggcaaggtcacttttacacgtgacgcgttcaagccggaaattaaaaaccatttctcacaggacgtgttaaacgagtatgccgacgcgctcgagactgagctgccgcaaacaacggcgctgttgaccatcaacgacacgattcctgaagacagcgtcgtcatcagttcggcgggatctcttccgggcgatctgcagcggctgtggcattccaacgtcccgaatacgtaccatctggagtacggctattcctgcatgggatatgaagtatcgggcacgctcggcctcaagctggctcatcccgacaaagaagtctattcactcgtcggcgacggaagctttctgatgctgcactcagagctgattaccgcgcttcaatataacaaaaaaatcaatgtcctgctctttgacaactccgggttcggctgtatcaacaacctgcagatggatcacgggagcggcagttatttctgcgagttccgcacagaggacaatcagattttaaacgttgattacgcgaaggtggcagagggctacggcgctaaaacatacagagccaatacggttgaagaactgaaagcggcgcttgaagatgcgaaaacgcaagaggtatccactttaattgaaatgaaggttctgccgaaaacgatgacggacggctatgacagctggtggcatgtcggcgtggcggaagtgtctgagcaggaaagcgttcagcgggcatacgaagcgaaagagatgaagctgaagtctgcgaagcagtactagaggggaggcatcacgatgggcaaacaaaatattttgtggggcatcgctcccattgggtggcgcaatgacgatatgccggagatcggagccgggaatacgctgcagcatttgttaagcgatattgttgtcgccggttttcaaggtacggaagtgggagggtttttccctgaaccctccgtcctcaataaggagctggctctccggaacttgcggattgcggggaaatggttcagcagctttatcattcaagacggtattgaaaaaacggctgaacaatttacagaacactgtgattatttgcagaaagtcggagcggatgccgccatcgtttctgaacagacgtacagtgtccagggcttggatattgatgtatttaagaaaaaaccgcacttctcaaatgaagaatgggatacactgtgccaaggcttgaaccgtctcgggaaaatcgctgacgaatacgggctggagctcacgtttcatcatcatctcggcacaggcgtccagacggcggaagaagttgaccggctgatggatggaacggacccgcggtatgtccatttactttatgataccggccatgcctatatctcagacggagactatatgacgattctcaacaagcatatggatcggatcagacacgttcatttcaaggacgcgcggtttgacattatggagcggtgcagacaggaaggcaagtcattcaggcagtcgtttttacagggcatttttacggtgcccggagacggatgcatcgattttaccgaagtgtaccaaacgctcgtccgtcatgattattcaggctggatcgtcattgaagccgaacaagacccggcagtcgccaatccgcttgagtacgcgctgattgcgagaaagtacatcgacagtgaactgcttgatcctgcaaattagagggggacttatatgaatagtgccaaggcggaatcagctttcagcaaacggaccatcgccgcagcattagcaaattacattgatgcaggttccatcgtggcaggatcagcgggtttatctatgtgggtcagctacttgaagctgtccgacagtcagatcggattgctcggcgccttcagcgcaaacgcgatatcagcggccatcggagcgctgctcggcgggtatttggctgataaggtcggccgaaaagctgtatacacaaacagtatgctcgtctacgctttaggaatttgtttggttttgtttggattcaactttcccatgctgttatgcggatacatgattatcgggatttctgtaggcgcggatattacggcttcatggaccattatcgcggaaaacgcccccgagaaaaaccgggcgaggcattgcggagtggcgcaggtggcgtgggccgccggagccgttgtggttctgctgttatccgttttggtcggtgacctcgggcttttaggaaataaaattgtctttgcgcatctattggtgatcgccctgatcacatatgtgataagaaagcgtttacctgagtcggatgcctggaaaaacagtgaagagcggcctgccgccgtgaaaaaaacatcttattttgacttgcttcagccgaaatttttcaagaacattttgtttttaatgggtgtgtttctcgtatggaatctcgccgcgggcgtcatgggattcttcatgccgtacatctaccagcaggtcggcggcgtatccgcaaatacggccaacattctgcagatggccctgtttatcttcaccgggctcggcgtcgcctgtatcttcatgccttttgcagatcaatatcggaaaacggtgttcggaatctgcgcctttatggctgttgtcggctggtcgctgtttttgctgccgtttcagggactcccgatgctgcttttgtttgttttagcgatcggcatcaataacggagccggccagcaggcgaactaccagctgtgggcaagcgagctgttcccgacagaacacagagcgtcagcacaagggctcatgttctttctcgtccgtatttcaatcggcatttggagtttatttgtgccggtcatcatgtcacaattcggcatcggttttatggccggtattctgctcatatgtgtgacggccagtatgatcatcgggcttgtcttcgcaccgaatacgtccggcaagtcgcttgaacagatacaggaggaactgtacggtgctcctcaggacggcagagagaaaagaaagacgagaaccattatttgattatcagaaggagtggcgatcaatgaatttacgtataggtgttatcggaaccggtgctatcggaaaagagcacatcaaccgcatcacaaataagctgtcgggcgcggaaattaccgctgtcacagatgtgaatcaggaggccgcgcagcagaccgttcagcatttcaatttgaacgcctcggtttatcctgatgacgacagccttctcgctgctgaaaatgtggatgccgtcttagtgacaagctggggcccggctcacgaatccagcgtgttgaaagcgattcagcacggcaagcacgtgttttgtgaaaagccgcttgcgacaacggcagaaggctgtatgcgcattgtcgaggaagaaatgaagacgggaaaacgattggtgcaggtaggtttcatgcgcagatatgacagcggttacgttcagctgaaagaagcgatcgacaaccgtgcggtcggcgagccgctgatgattcactgtgcgcaccgcaacccgacagtcgcatcgaattattcaacggacatggccgtcgtcgatacgctcgttcatgaaattgatgtcctccactggcttgtcaatgacgactatgaatccgtacaagtcatctatccgaagaaatcaaaaaatgcgctgccgcatctgaaagatccgcagatggtcatcatcgaaacaaaaggcggcatcgtcatcaatgcagaaatctatgtgaactgtaaatacggctatgacattcaatgtgaaatcgtcggggaagacggcgtcattaagcttccggaaccgtcaagcatcagcttgagaaaagaaggaaaattcagcaccgatattctgatggactggcagcgccgatttgcggctgcgtatgatgtggaaattcaggacttcattgattcgatccggaagaaaggcgaagtcagcggtccgacggcatgggacggttatattgccgcggtgacaacagacgcgtgcgtaaaagctcaggaatccggacagaaagagccagtggcgcttcaagagaaaccggcattctatcaatcatttacgactgtgaacaaataatagatcgggagtgaaaaaatgaaactggccttagatccatccatgtaccgcgatgatttaacattagaggaaatggtctataaaacggcggaactcggatacgaatatatcgaactgtccccgcgcgaggatttttgtcctttctataaatatccgaaagtcgattcagcaaaaatcaaacaattgaagcgccttttaaaggatacaggtgtgaagctgtcctcccttcttccgctttaccactgggcgggtcctgatgaagaccgccgccaggccgccgtgcgcaactggaaacgggcgatcgaaattgcggttgaacttgaagtggatttgatgaacagtgaattcagcggttcaaagtatgatccgttgacaagtgaagaaaaattcatcaaatccatggatgagctgctgcccgtctttgaaaaagaaggcgttaaactcaatcttcaagcccatccatacgattttatcgaaacgcacaaaggtgcgatggatatgatccgcgcgctcgataaggattggatcaatcttgtctactcgactgcgcatacgttcttctatgatgacggcaaaggcgatatcgaaaccatgtttgatgaagccggcgaccgcctcacacatgttttatttgcagatacttttaatcataaagcggcgcacggcctgcgttacatcgtcaatccgcctgatgcgaaagtaacggttcaccagcatctggacatcgggcaaggcgaggtcgattttgagacgattttcagaaagatgagagagatgaaattcgacggaattgcgacgaacgccgtgtttgcttgggtcggcgaaagagcggatgaatcaagccggaccacgcttaagaaattaaaggaagaactgggtatggcataagctgagtatggagttcggcggagcggggcaaaaaagcccttcagccggactcccttcatatcgaaaacgcggatgggagaggctgacatgaaactttgctttaatgaagcgactacgctggagaattcaaacctgaaacaggatttagaactgtgcgaaaagcacggctatgattatattgaaatccgcacaatggataagctgccggaatacttaaaagaccattcactggccgatctggcggaatattttcatacccatcatattaaaccgcttgccctgaacgccctggttttcttcaacaatcgtgatgagaagggttatagggagatcatttcggaattcaaaaaaatgatggaaacctgcaggacgctcggcgtgaaatatgtggtggccgtgccgcttgtgacagagcggaaaatcttgaaagaagaaatcaaaaagagcagcatagaggtgctgactgagctttcggacatcgcggagccgtacggcgtaaacattgcccttgaatttgtcggccacccgcaatgcacggtcaatacatttgaacaggcgtatgacatcgtgaacgctgtcggccgcgataatgtcggactggtgtttgacagcttccatttccacgcgatgggctccaatattgagagcttgaagcaggcggacggaaagaaaattttcatctatcatatcgacgatacagaagactttccgatcggctttttaacggatgaagaccgcgtctggcctgggcagggtgcgattgacttagacgcccatctgtcagcgttaaaagaaatcggattcaatgatgttgtctccgtagagctgttcagacctgaatattataagctgactgcggaggaaacgatcaaaacggcaaaggaaacaacggaagccgtcgtatcaaaatacttcatgaaggaggcgtgaacatggcttttgtcaccatgaaacatcttcttgcagaagcgaaacgggagcattatgcagtcggccaatttaatatcaacggcctccaatggacgaaggcgattctgcaagcggcgcaaaaggagcaatcgccggtcatcgccgcggcttccgatcgtctggtcggctatttaggcggatttaaaacgatttccgccatggtcggcgcgttaatggaagaaatggcgattaccgttcccgtcgtgctccatcttgatcacggaagcagtgcggaacgctgcagacaggccattgacgccggattcagctcagtgatgattgacggctcccatcagccgattgacgagaatatcgcgatgacaaaagaagtcaccgattatgccgcaaagcacggcgtctcagtagaagccgaagtcggcacggtcggcggcatggaagacggacttgtcggcggggtctgttatgccgatatcatggaatgtgaacggatcgtgaaagaaaccaatatcgacgcgctggcggccgccctcggctccgtccacggcaaatatcagggcgagccgaatctcggatttaaagaaatggcggctatctcccgcatgactgatattcccctcgttctccacggagcatccgggattcctcaggatcagatcaaaaaagccatcacgctcggccacgcgaaaatcaatatcaacacggaatgtatggtagcctggacagacgaaacacgccgcatgtttcaggaaaacggcgatctgtacgaaccgcgcggctacatgacacccggccttgaagccgtggaagagacggtgcgaagcaaaatgagagagttcggatcagccggtaaagccgtaaaacagcagatcggctgatgaaaacggaaaccgccaagatggcggtttttttgtgcggtgttgcgtccgtacgcccgaaacgattatgatgatggcagcagtgtaagaaacgggagtggttcagtttgaataaaatcatgattgtggaagatagtgaagacattcgcggactattgcagaattaccttgaaaaatacggatatcaaaccgtggccgccgcggatttcacggctgttcttgatgtctttttgcgggaaaagcctgatgtggtgctgcttgatatcaacctgccgtcttatgacggctattattggtgccgccagatccgccagcattctacaagcccgatcattttcatctcagccagaagcggggaaatggatcaggtgatggcgattgaaaacggcggagatgattatatcgaaaaaccgttttcttatgatattgtgctggcgaaaatcaaaagccagatccgcagggcatacggagagtacgccgccaagcagggagagaaagtggttgaatatgccggtgtgcagctctttgtggaacggtttgaactgcgctttcaggacgaaaaaagcgagctttctaaaaaagaaagcaagcttttggaagtgctgctggagcggggagaaaaggtgacgggaagagaccggctcatggaaaaaacgtgggacaccgacattttcgtcgatgataatacgcttaacgtgtatatcacgcggctcagaaaaaaactgcgggagctgaacgcgcctgtttccattgaatcggtgcggggcgaaggctaccagctgagggcgctgtcatgaagctgtttctccggtctcatgccgtgctgattctgctttttctccttcaagggctgtttgtcttcttttattactggtttgcgggtcttcattctttttcccacctgttttacatattgggcgtgcagcttcttattttggcggggtatcttgcctatcgctggtacaaagaccgcggtgtgtatcattggctcagctcggagcaggaagggacggacatcccgtatctcggttcttcagtgttctgttcagagctgtatgaaaagcagatggagctgacccggctgcagcaccagaagctctacgagaccgaagccaagctcgacgcgcgggtgacgtatatgaatcaatgggtgcaccaagtaaaaacgccgctgtcggtcattaatttaatcattcaggaagaggatgagcccgtctttgaacaaatcaaaaaagaggtccggcagattgaattcgggctggagacgctcctttattcatcaaggcttgacctgtttgagcgggattttaaagtcgaagcggtttccttatcagagcttctccaatcggtcattcaaagctataaacgattttttattcaataccgcgtctatccgaaaatggatattcgcgatgatcatcagatttacaccgatgccaaatggctcaaatttgcgatcggccaagtcgtcacaaatgcggtcaaatattcggcaggcaagagtgacagactggagctgaatgtcttccgcgatgaagacaggacgatgcttgaagtcaaagattacggtgtcggcattccctcgcaagatatcaagcgggtgtttgacccttattacaccggcgaaaacgggcggcgtttccaagaatctacgggaatcggcctccatctcgtcaaagaaattacgggcaagctcaatcatacggtggacatcagctcgtcccccggtgaagggacatcggtccgattttcatttcttacaaaaatgtaagactgcgttaagaaaacaacatagctcattctgtttccccttgataacatggatttacgtcaaggggattttttatgctgaatgccccggcactacatgaaagcagcccagatcaacaagaataaaaccataaggaggattctcatggcgaatatgcttgaagtcaaacatataaataaaacctataaaggacaagtatcctatcaagctttaaaacaaatttcattttcaatagaagaaggcgggttcacggcggtgatgggaccgtccggctccggaaaaacaacacttttgaatatcatttcaacgatcgaccggccggattcaggcgatatcctgattcacggagaaaacccgcaccggctgaagcggacaaagctcgctcatttccgccgcaagcagctcggatttgtgtttcaggatttcaatcttctggacacgctgacaatcggtgaaaatatcatgctgccgttaacgcttgaaaaagaagcgccgtctgtcatggaagaaaaactgcacggcatcgcgaaaaagctcggaatcgaggacctgctcaataaacggacgtttgaagtatccggcggacagcgccagcgggccgccatcgcaagagcggtcattcataagccgtcacttattctggccgatgaaccgacgggaaaccttgattccaaagcgtcaaaagatgtcatggaaacgatgcagagcctgaatcaggatgatcatgtcacggctttgatggtgacccacgatccggttgcggcaagctactgccgccgcgtcatctttataaaagacggcgaactgtttaatgagatttaccgcggggaaaaccgccaagtcttttatgagcagattcttgatgtgctgtctatgctggggggaaacgcaaatgacctttcttcagttcgcttataaaaacgtcacgagaaacaaaagggcctatcttgcattcttcttgagcagcgccttttccgttttgattttctttacctttgcgatgttcctgtttcatccggcactaaaggaaggctacctgaataacatcgccaaaaaaggcttaaccgccgcggaatggatgatctttgttttttctttcttatttgttctgtattcggttaacgcatttttgaaatcgagaaataaagaattcggtattctgctgatgcagggtattacgccggtgcagctgagaaagctcattacggcggaaaacatgatcatcggcgtcatgtcgatcgcagcggggattatcggaggcttcattttttcgaaaacgttctttacggtcggcgcttatattttagaaatggacgcgctgcctctgtacatgccttggaaagcgctcggcattacggccggcggatttctgctcttatttttccttttatcgcagttcacgatcctttttgtcagatcaaatacggtgatcaaattaataaagggcactgacaagatcaagccggagccgaagccgtccgtgcttctgtccttattcggcatcgcctgcctgtgcggcgggtacggcatggttctgaaaggcaatgtccacgggaccgagccgttcatcattttactgcttaccgtcatcggcacgtatttctttttcagccaaagcagcatctggattctgcgcgcgctgaagaagtggaaaaccttttatctgcgcgggaaaaatgttatttgggtttctgaccttgtctatcgtttaaaagacaacgcccgcctgttctttatcgtcagtattatttccgcggttgcctttacggcgacgggcgtgctcgcgatgtacaaatcgaccgtcggggcggaagagtccgcctatgagatggagtatttatctttcagcaataacccgaaagaacagactcatttgaaagatattgaccatgaactgaaaacacacggctttacgtataagaaagacaaaatagatgtttcctatgttcgctatcaggaaggagaaactgttccccctgtttatatgatcagcgaatcggatgtatcaacatacttccatgttaagctgaacggcctgaaacataatgaggctgtctatttcccgggcacgtatgaccgcaatttcaaaaacgacgcgccggatcagctgaagctgctgaaccaaaaaggcaagccgtctgaccaaaaactgacggtaaaagaagtcaaaaaaccgctgatttcattgaatgccatcatcgcggtgaacgatcaaacctttgatcagctgaaatcactcggtgagaaagcgtcattatacggctacagctatgatcattggaaagacagtcttgggatcagccaatccttgaaaaatgagatttacggcaactatatcgacgtgcattctgattttatggcaaaagccgggacgtactatgatacggtgcagctgccgagcctgagtttattcatcggcctgtttatcgcgatcgttttctttgtcgcggcagcgagtttcttatatttcaggctgttcaccgatttagatgaggaccgggagcgctaccgctcattggccaaaatcggtctgagtgagcgtgaaatggcacaaagcgtgacgatacaattggcgattctctttttctttcctttcgtcattgccgtcatgcatacgctgtttgctttgagaacattagcggtggaaggctattccgatgtagcggggccgctcagtctgaccatcggagggtttttcatctttcagcttctgttcttcctagcggtgcggacaagctatttgaaaaaaatgaacaagtaaggggagtgcacagatgaaaaaagcattggcaatcctggccgtcttagcagccgctgccgtcatatacggacttctcttttttcataatgatgttacagacagatttaatccgtttattcaccagcaagatgtttatgtacagattgatcgagatggcaaacatcttagcccgggcggtactgagtatacattagacggatataacgcatccgggaaaaaagaagaagtgacctttttcgccgggaaagaccttcggaagaacgcgtatttgaaggtgaaggcgaaaggaaagtatgtcgagacctgggaagaagtcagatttgaagatatgccgggctccgtacagtcaaaattaaagtgaacatgaaaaacggcacagtgtcatgactgtgccgctttttttattttttattttttattttcttcagcccgtttgatcagcatgtcggtgatgatatccatctgtttgctgacggcaatcgggtcatacggatagaaggtgttgaaatcgttgataaagacacggttgttctttacggcatcgagatttttccaaacggatgactctttcagacgctcaaatgttttgctttctccattcggattgtaatcggtaatgaacatataatcagccgcatattgagggatgacctcttgggaaacctgtttcatggcgcccgttttcatgatgtctttttcgattttggccggcgctttcaatccgagtgcgttataaacggcttggccgccgcggccggaattgtcattaaaaatccagatttcgcctttatccgtcgtttcataaaggccgactgtctcgtctttgccgatcacgtttttgaggcgcttttgatcggcttcagcctttttgttgaagtctgccataaagcttttggctttatccttcgccccggcaatgtcgccgaataggctgaccgtatctttcgtattctttgcggtgttaaaaggaatgacaatcgtcggtgcgattttcgatagtttctcgtattggtcatccttcatcagcacgattaaatcaggcttcagctgcatcactttctccacattgacgggattgccgatgtccgtggtgtttttcagctgttttttgataaacggatttttgaaagcccatgagcccgccccgacgacatttgcgtcaacggacagcagctcacccgcataaaagtcagtgacgatccgttttggatgtgcgggtatgtcaatatttccttttgttgattcatatgtacgcatgtctgtctttcctttgcctgatgccgatccgttgttttccttcgcgccgctgcaagcgcttaatgcgaaaacaagcagaagtgccaggccgatcagccatgattgtttcttcataatgatccccctatttcggtgataatgattatcattattaatatagcaggaagacgtcattccgtctatgttttttatagaaaaccttccttgattatccatgttatagtagtaaaggaggaggaatgaatgttgattacgaaaagagggacttggtgggaagtgctgcacagctggtggctgctgctgactttcgcgccgtttgggctgaccgctttcttggcctttttctatatcggctaccgggccaagaacaaaaaatggctgaaatacggacttatctattttattattttagcaattgcttttgtgctgccgagcacgccgggcgtgtatatcgtgctgcctttatgggtcatctccatcatccacgggctgaaagtgcgggcggcttatttaatacagcttgatgtgtttaaacaaaacgtcgaagcaagagcgtttgaagcggtaaggcatgaggcggaggaaaaattcggcggaaaacccgctcaacgcattgatctgacaaaacagagataaaaacaaatgacaaagccggtatctcgcgctttgtcatttgcatgaccggcctattgctggtatgaatgctgctgaaacggtgtgtgtgatgctgtgtttgcgggaatgaagaaacattagcgtttgccatcggtgcaggcatgtgtccgcttacttcctgctgaagctgattgcacacattcacgatttgctggcatttctgaatggccagttcatgcccctgcagcgcttgctgaatggtatgaacggcatgctgttcatggttaagcatctgctgaagcatttgaatgttttgctgttcctgctggagcatttgcttgtactgctgactgctttgctgtgtctgctgaataagctgctgtgctgtttgacggcattgctgcagctgatttccgctgtattggttttgatacatcatgaagacctcctgaagtgattgattttacacatttatcatgtgaaagaataggagaggcattcatgcaagaaaaggattcaaatatttacctgttatgtacagagcggaatacaaggctcgggatggcctgtcgagctttgtattccggccctttttctcagaagccgccttctgtagcgtgaaaaggaatattgagtctgttttcgactgcgcgcaggcgctgattcaaacggtttaagcggcgggtatggatttcaatggactggctcagccgtctgatctgctcattcatacgcgtgatttcccggttttggcgctggtcttcttgtgagaggcgggtgagctctctcgtttgctgggcgttttgtctttcaagctgggcgactctccgttctaaagccgtcggctgccgctcttcagactgagggggcgcataataatagctttcctgctgctgatacggctcatactcaacggggctcacttcgtattcctgctgctgagggaaataggcagatggggtgtagtactgatatgggttcattcatcattctccttatctagtgaagtctttatacactatgtagtcaattgcacagtgccacggcatccgcctaacttacaggcgtaaaaagagcttcaaaggaaggtgatcatgttgcggaacatacggattttcatcatgacggttcttgttatcggatgcgtcatgataacaggctgctcgcaaaagaaagcagacgaaccccctttttattacgggacatgggatgcggggctgaaaccgggcccgatggacggggtcagatctgaaaccgttacgtttacgaaagacagcgtgctgacaaagcaggtcattaaaggccgcggcgaggttcccatgccctcagatgcttacaaggtggtctcacaaaacacggacgggacgatcgagattgaatacctcggacatccgcaccccgtcaaaagcacgttgaaaagaggaaaaaacgatacgctcatttggaagatatacggagaaacaaaaacaatgacaagaataaaaaccggcggggaggatgcacatgagaaataaggctgccgacagactcgttttgacgggtgtcatcgtacatatcattcaatggttttcactgttatggttattttttatgctttttgatcagttcgggcgttttaccatttataatcccaatgtcgtcaacggcagcatgcagtctttttcattctttgatatgatgcgcgctcttctgttttccggcacgctgcggaatacgctcctgctgtttctgtttgcggcgatgctcatttacttgtgggtgaacgctctgtttatcctgctggaaatcgtttcttatatcatgatcaggcggaacagccgttcattatgggcatactttcccgcagcgatgggaataaagcttgcccttctggacatagcggccgtccctttctttgcggcggggctgatgctcttgaagcagaaaacagatgacagcggcgaacaagctgacaaggggaaaagacggccccgcatccggaggcaggcccggtataggaagagaaggcggagaaacttgtccgtttgatttttcattgaaacgaaaaaacgatatgatgaaagcataagcagaaaaggatacaaaggagatgcaggatgtacaagttaatcgcaatagatatggacggaacactattaaacgatcatcatgaagtgacggctgaagtccgcggggcgcttgatgccgccaaagcggaaggggtcaatatcgtcctgtgcacgggccggccgatcggcggcgtgcgtcggtatttggaagagctgaacttacaggaagaaggagactttgtgattgcctataacggcgcactcgtccaaaatacgtatacaaacggtgtcgtggccgagcagtcattaggctttgaagatttggagtcgctttacgagctgagcttacagttggatactccgatgcattactttgacacagccaatctgtacacgccgaaccgggatatcagtgaatacacggtatacgaatcatacattacgaaagtgccgcttcatttccgcacgatcgatgaagtgccgaaggatattctgattccgaaagtcatgttcattgacgatccggacaagctggagaaagcgatcgcttctattccggaatcattcagggaaacatacacaatggtcaaaagcgcgccattcttccatgagattcttcacccgaaagtcagtaaaggaaacgcggtcaagctgctggccgaaaaactcggcattgaacagaaagacgtcatggcaatcggcgataacggcaacgacatgtccatgattcagtgggccggctgcggtgtggcaatggccaatgccatcccggaagtaagggagattgctgattatgaaacgaaatcaaataacgaacacggcgtggcgcacgcgattcaggagcttgtgctgaaaaaataggcaccccatcagagggtgcttttttaccgcgtgttttggtgatatgataagcggagaggggaggcgcgacatggatcgtgaaaaacagcagctcagcatagaagcggcaaaactatattatcaatcagattacagccagcagcagatcgccgaacggcttaatctgtcacgccccaccgtttcaaggctgcttcagtacgcaaaggaaaaagggtatgtgcaaattcgcgtcatggacccgtttgaggatctggatgaactcggcgcgaagctggaagaaaaatacgggctgcttgaggcgcacgtcgtcttttctccaagcgacgattaccaggccattacacattacttaagccgctatggcgcagactatatgcataaaaccgtaaaggacggcgatatactcggcgtaagctgggggacgacgatgtaccagatcgcaagccgcatggagccgaagcaggtaaagagcgttgaagtcgtgcagctgaaaggcggcatcagtcattccaatgtcaatacgtattcgtcagaaacgattcagctgttcgccgaagcatttcagaccatgccgaggtatttgccgctgccggttatatttgacagcgccgatgtgaaacagatggtcgagcgggacagacatattaagcggatcattgaaatgggcagacaagccaatatcgccctgtttacggtcggaaccgtccgggatgaggcgctgcttttcagactcggctatttccgggaagaagagaaacaattgctgaaagcacgcggagtcggcgatatttgttcgcgcttttttgacgaggaaggcaggatttgcagcagcagcattaacggcaggacgatcggagttgagctcagcgacctgaaattgaaagagcgttcgattctggtggcgggcggcagcagaaaatgcaaggccattcacggtgccctgaaaggaaagtacgccaacgttttgattactgatcagcatacggccaaaaaactcattcaagaattgtgacaattcatgaacataatttcaattaccaatttacatatgttcaaaattcggttattctaaacgtatcctaggaaaaaggaagtgcatacaatgtcaattgcaagtcaaatagaccatactgctttgaaaccgcatacacaaaaagcggatattttacaactgataaaagaagcaaaagaatataaattcgcttccgtttgtgtgaacccgacttgggtcaaactcgcagcggaggaactgaaaggcacgggagttgacgtttgcaccgttatcggatttcctctcggcgcaacgacatcggaaacaaaagcatttgaaacgaaggatgccatctcaaaaggagccactgaggttgacatggtcatcaatatcggcgcattaaaagacggcgatgatggagcggttgaagctgatatccgcgcggtagttgaagcagctgataaaaaagcgctcgtcaaagtgatcatcgaaacatgccttttgacagatgaagaaaaagagcgtgcgtgccgcttggcggtatccgcaggcgctgatttcgtcaaaacgtctaccggtttttctacaggcggggcaacggctgaagatatcgctctcatgagaaaaacagtcggaccggacatcggggtcaaagcatcaggcggcatcagaacaaaagctgatgttgacagcatgatcgctgcgggcgcgagccggatcggcgcaagtgcgggcgtctctatcgtgagcggcggagacagcggcagcagcgactattaatcagcattgcggaagccgaaagcttccgccatcctctttctttgttgatgcataaaaaattgtaagcgaatacaaataaaaggagaacacatatgaagtatctcatcggaattatcggaatcattgtgtttttaggtcttgcctggcttgccagcaacggcaaaaaaagaatcagaatccggccgatcgccgtcatgctcgtgctgcagctgattctcggttatattctcctcaacaccggtatcgggaattttcttgtcggcggttttgcaaaaggatttaactacttgctggaatatgcatcagaagggattaactttgtattcggcgggcttgtgaatgcgaaacagacgacgttcttcatgagcgtgcttctgccgatcgtctttatatccgctttaatcggaattctgcagcattggaaggtccttcccttcatcacgaagtatatcggtcttgcgttaagcaaggtgaacggaatggggaaaatcgaatcttacaacgctgtcgcatccgcgattttagggcaatcagaagtctttatcagtttgaaaaaacagctcggctatcttactgaacagcgcttatacacgctttgcgcgtccgcaatgtcgacggtctcaatgtcgatcgtcggttcttacatgatgatgctgaagcctgaatacgtcgtgacggcgcttgtgctgaacttattcggcggatttatcatcgcttctatcatcaacccgtacaccgtcagcaaagaagaggatttgatcttcgttcctgaagaagaaaagcaatccttttttgaagtgctcggtgagtatataatggatggattcagagtcgccgtcgtcgtagcggcaatgctgatcggatttgtcgcactcattgccctggtcaacggcgtttttaacgcggtcttcggcattacattccaggcgctgctcggatatgtattcgcgccgtttgcgtttttaaccggtattccgtggaatgaagcggtgagcgccggaagcattatggcgacgaaaatggtatcgaatgaatttgtggcgatgcagacgctctcatccggcgatttccatttcagcgcgcatacacaggcagtggtatctgtattccttgtctcattcgcgaatttctcctctatcggaatcattaccggtgcggtgaaagggctgcatgaaaaacaaggaaacgtcgtcgcgcggttcgggctgaagctgctgtacggcgcaacgctcgtcagtttcctgacagcggcgatcgtcggattgattcactgaacataaatgaaggacaggtgatagatcatgagaatggtagatcttattgtaaaaaaacaaaatggaaaagaactgacaacagaagaaattcaatttttcgtaaaaggatacacggacggaagcatccctgattaccaggcaagcgcgctggctatggcgatttactttcaggatatgacggatcaggagcgcgccgatctgacaatggcgatggtcaattcaggggaaacgattgacctctccgccattgaaggcattaaggtcgacaagcactctacgggcggggttggcgacacgacaactctcgtactcgctccgctcgtcgcggcgctcggcgttcccgtcgctaaaatgtccggccgcggccttgggcatacggggggaaccattgataagctggaagcgatcgaaggcttccacgtggaattgtcaaaagatgaattcatcaagcttgtgaaccgcgacaaggtagccgtcatcggacaaagcggcaatttgacccctgccgataaaaagctgtatgcgctgcgtgatgtaacgggtacggtgaattccatcccgctgatcgcaagctcaattatgagtaaaaaaatcgccgccggagcagatgccatcgtgcttgacgtcaaaacgggagccggcgcgtttatgaaaacggatgaagacgccgtgaacctcgccaaagcaatggttcgcatcggaaacaacgtcggccgccagacgatggccgtgatttctgacatgtcgcagccgctcggttttgcgatcgggaatgctctggaagtgcaagaagccattgatacgttaagaggggaagggcctgaagacttaaacgaactcgtcctcacgctcggcagccaaatggtcgtattggcgaaaaaagctgagacattggaagaagcgagaacgaagcttcaggaagtcatgaaaaacggcaaagcgcttgaaaagttcaaagagttcctgagcaatcagggaggagacgcttctgtcgttgacgatccgtccaaacttccgcaggcggcgtacaaaattgacgttccggcaaaagaagcgggtgtcgtttcagaaatcgtcgctgacgaaatcggcgtcgcagcgatgctgttaggcgcgggacgtgcgacaaaagaggacgaaatcgaccttgccgtcggtattatgctccgcaaaaaagtcggtgacaacgtcgaaaaaggtgagccgctcgtcaccctttacgccaaccgcgaaaacgttgacgacgtgaccgccaaagtctatgacaacatccgcatctcagaaaaagcggaagcgccgaaactgattcatacgctgattacggaataagacaaaaaaggcacatacctcatcagtatgtgcctttttttttatggcatggttttatccaaatgaatgtcacggacggattgtttcggctgtttctttctcaaaaaacgaatgagatagcacaggatcatacaaggaattccgcagaagagggcgattctttgattgggatcaaatgcaaggcctacgcatgaagcgaaacataagatcacagcggcgatcggaacgagagggtataacggcgtgcggaaggtcagatccgcgacgcgtccgccgtttttcacataatgttttcgaaataacagctgagacagggcgatgctcatccacaccacgacgccggcaaatccggctattgccacgagcaccacgtagaccgtgcccggggcggcgatgcttgagatcaaggatatgcaggaaacggccatgctggcgagcagagcattcagcggaatgcctttcggcgtgacttttttgaaccgggcgctgatcatgttttcattcgcaagagaccacagcatccgggtggaagcatacagtccggagttggcgaccgaaagcaaagccgttaaaatcacgaagttcatgatatctgcggcgtatgggataccgatctgggaaaagaccgcgacaaacggactttcaatcacaccggcttccttccaggagatcagtccggacagcacaaaaatggcgccgataaaaaagatgaccgttctccaggcgacatttcggatcgaacgcggaatatcttttgccggattggcggtttcacccgctgtaattccgatcagctccgtccctgaaaaggcgaagcttacggaaatcattgcgatgaaaaccgcaagaaagccgttcggaaacagtccgccgtgtgaggtgaaattcgacagcatcggagcttcacccgaaccgtgcaatgaaatcaaaccgaacatcgcggcgccgcctaagatgataaataaaaggatggtgacgattttgacgctggaaaaccaaaactctgtttctgcaaacaatttaacggagaatgcattggcggcaaaaaggagagccgcgaaaatcgcgctccacatccagacgctgctgtggggaaaccagcgctgcatgaggataccggaagctgtaaactccgatcctaccgtcaccacccaattcacccaatacatgataccgaccataaaacccgtggacggcccgataaacgttgtcgcatacgtttgaaatgaaccggtcacaggcatggctactgacaattctccgagacactgcatgacaagatacatcatcaagccgccgatcaggtaagcggcgatcgtcccgcccggcccggcctggctcaatgtataccctgtgctcaaaaacagccccgtgccgatgacccctcccaatgaaatcataaataagtgcctgcttttcatcgtgcgctttagttgattgccgccttgatcaacatccatcgtgatctccccctttttgcgtggcatgagaatcttccggcagccgagatcacgcgtgccggatttgactttaacgtgacaatttaaatcccttcaatgcatgtaaaatgacgtgtgcggctgcccggcttgtcatatcgcgaaaatcaagtgtcggatcaacctcaacgatctcaatacccgagatgtcagcctcctgggctaaaaaccggaccgcctgaagcagttcctcggtatacaggcctccggggccgatcgcaggacagccgggcgcatgagcttgatccagcacatccatatcaaccgaaataaaaatggcgtcggctcttttttgaacggccggcaaagtgtcttgtatcgttcggagaagccctttctcccggatcatctccattgtatgcacgtctgcctgacgctcttttacatatttttcatatgccaggctgttgctgaactccctgattccaagctgaatcaggttttgtccgcttatgatattttcatctaacagacggcggaatggcgtgccgtttgtcggccctccgtcttctgtgttgcggacgtcgtggtgggcgtcgaattgaaagacggccgttgttcctttcgtttccgcaatggctttaatggtggaataactgatggagttgtcgccgccgagaatgacgggcacccagtcaggctggtccgtcagaatatcataaatggtccgataaatgtgttcgtgagatttgacgacatccgtgacgtgaatctgaatatcgccgatatcgtacagatggtcaatgacatgctcccgcagctccgcggaatatgcggaaatgccgccgagcgcccggcggatcgcaccgggggcaaagcaggcgccggaatggctgattgacgacttagaaagcggaacgccgatcaaagccggccctttgatcgtttgtcccgcccacgcttccgtcacatcgccgatccttgtcacatggcggtcgttgaagagggagccggctttttgcagaaacggatacttatccaagagcggctccctcccttgaaacgaccgtcttcccgttcttgatgacacggcggacatgattgacgccgtaatgatacgggatatacatgtaattcggcgcttcccaaatgacaatgtcagccgcccgtccggctttgatttgtccggcctcttcgccttttccgatcgcatacgcagcgttaacggtgacagcgtgccagatttcttctgcggtcatttttaaatgaagcgcggcaattgacataatgagctggagattttccgtcggtgagctgcccgggttgaagtcagtcgccaaactgacccgtacgcccgcatcaatcatctcccgggctctcgcataagtgtgttttccgagatagaaagtcgtgcccggcagcaggacggcgatcgttccggactccgcaagcttttcgatgccttcgtcagatgcccccaccaaatgatcggcagaaacagcatgcagctctgccgccaattccgcgccgccgagcgggtcaatctcatcagcatggattttcaggccgaaaccagcttcagccgcctttttcaggtagtcccgtgactggctgacggtaaagacgcctgtttctgtgaaaatatcggcaaattgcgcaaggcctttttcttttatgtcaggcaaaagctgcagcatgcgattcagaaattcgtcagggctgttccggtactcaggcggaatggcgtgtgctcccataaaggtcgtgacaaggtcgaccggctggcgctcacccagttttttcgccgcggtcagctgtttcagctccgtgtctttgtcgagtccgtacccgctttttacttccgcggtcgtgatgccgtatgacagcatgcgtccgaggtgaaaaagccctttttcaatcagttcttcttcggaggcggctttcgtgtctttgaccgttgacaaaataccgccgccttgcgccagaatatccaaataagacatgccctgaatttttaaattcagttctttttcgcgggaccctccgaatacaagatgggtgtggggatcgacgaggccgggggtgacgagccgtcccccgcagtcgataatgtctcctgcctcgtatcctttctccgctccttgatgtccggcaaaaacaatgcgcccgtcgtgaacgccgatgacggcattttccgtgacatgaagatcctgcatgctcccgccggatcgggggccgccggattccatcgtcagcagctggccgatgttggtgagtatggtatctatttgtttcggcatgttaccgctcctttttcatcggtatcataatgtcttgttcctcggcgacttgaaccgctttttcataacctgcgtccgcatggcggatgatgcccatacccggatcgcttgtcagaacgcgggaaagccgttgttccgcaaggatgctgccgtcagcgaccgcgaccattcccgcgtgaagggaataccccatgccgacgcccccgccgtggtgaaaagaaacccagcttgcgcctgaggccgtgttgatcagcgcgttcagcaccgcccaatcgccgaccgcgtcgcttccgtctttcatcgcttctgtttcccgattcggagaggcgacagatccgcagtctaaatggtctcttccgatgacgatcggggctttcagctcgccgtttctgaccaattcattgatggcgagccccatcttttcccgttcaccgtagccgagccagcaaatacgggacggcaggccttggaacgtgacttttttctgcgccatgtcaatccagcggtggagggcttgattttctggaaacagctcttttaataaagcgtccgtgcggtatatatcttcagggtcaccggacagcgcagcccagcggaacggcccttttccttcacaaaataaaggccggatgtaggccggaacgaatcccggaaaatcaaaagcatcggcgagaccctcatctttggcagcctggcggatgttgttgccgtaatcaaagacgatagccccttttttcttgaaggcgagcatggcttccacatgctttttcatactctgcttggaaagccttacgtataaatcaggctgatcccggcgcaggcggtcggcctcctcaagtgagtatcctgccggaatatagccgatcagcgggtcgtgagcggaagtctgatcggtcacgatgtcaatatggacgccgcggttcaaaagctcatgatgcacctctgccgcattgccgagaaggccgatcgataaaggttctccggcttgtctggctgtttcggcccagcgcagcgcttcgtcaattgatgcggttttccggtcgcaatagtttgtttctatccgtttatcaatccgtgtttcatccgcttcaacggcgatgacgacgccatcattcatcgtgacggacagcggctgggcgcctcccattccgccaagtccggccgtcagcgtaagggttcctttcagactgccgccgaaatgctgtctcgcaagctccgcaaaggtttcataggtgccttgcaaaataccttgtgaaccgatataaatccagctgccggcggtcatttgcccgtacatcatcagtccttttttctcaaggtcatggaaatgctcccaatccgcccatttcggcacgaggaccgaattagccagcaggacgcggggcgcgcggctgtgcgtgcggaacagtccgaccggttttccggattggatcagcagtgtttcatcatcttttaacgttttgagggagcgctcaatcgcgtgaaaagcatcccagtttcgcgcggccttgcctatgccgccgtatacgatcagatcctccggcttttcggcaacctccgggtcaaggttgtttcggagcatgcggagcacggcttcctgctcccatcctaagcattcaagttcggtgccgcggccggcgcggattgatttctttacatcagtcatcttgtaagtcctccttcattggtcatcagtttttggtgatgctcattcggcagaaaagactccttcttcagccagtcactcagatgttcgatgtcataagaaaacacgcggtcttcttgtatggacggcacgatgtttctcatttcgagatagagctgttttgtgtacgaggcgcaatgttccgcaccccggtattccacggcctgcagcgcgcaaatggcttcaacggcaagcacccgtctcgtattcgcgatgatctggtaggcgtgccttgaggcgatggttcccatgctgacgtgatcctcctggtttgccgatgaaggaatggaatcgacactggcgggatgggccagggttttattttctgacacgagggaggccgccgcatattgcatgatcatcgctccggattgtaagccgggctgagggctcagaaagggcggcaggtcattcagctgcggattcacaagccgttcgatacggcgttcagaaatattcgcaagctcggccgccgccactttgagaaaatccatggcaaaggcgatcggctgtccgtgaaagtttccgcctgagatgattttggcgccgtcttcgaaaatgagcgggttatctgtcgcggcattcatctcaatttctaatttttcttttacatacgctaatgtctgccatgatgcgccgtggacttgaggaatacagcggatcgaataggcgtcctggacacgcagctccccttggacggtcgtcagcttgctgtctgacaagtaatagcggattcgctctgcgacatccatctgttcctgatatccgcgggcggcatgaatgtcctcgtcgaacgcatcgataatgccctgaaggccttcgatcgttaagctcgcgatccgttccgactgataggccagcttttcggcctcgaggtaagcgatcagtcccatcgcggtcatggcctgcgttccgttgatcagcgcgagcccttccttagaggtcaggacggccggctgaaggtttgtcttttccaaagcatgagctgccggcatccgggccccttcgtaaaagacttcgccttgcccgataagcgccagtgcgagatgagaaagcggcgccaaatctccgctcgcccccagtgacccttgctgcgggatgaccgggtgaatgcgatgattgagaaacgcgagcagttgatcaatcagctcagtccgtacgccggaaaagcctttcagcagggcattggcgcgcaaaagcagcatggcccgcgatacagattccggaaacggatcaccgacgccgcacgcgtgagaaagaatcagattcagctgcagatccgcggcgtcttctttttgaatcagcacatcgctgaacttgccgaaccccgtcgtaatcccgtaaatggtcttctcttcttgaacgatccgttcaaccgccgccctgctttttttcacacgttccatgctttcggcagatgcttgaacctcttcaaaatcaaacagcacacgctgggcatctgcggttgtcagtgaggaaccgtctaacgttaccatcatttcaacccctttttctttactttggtaaagcgcccatacaaaaaggagctatgccatgaaaatgatatttcacgcatagccccctatcatctgatatctatgggctgattcatatgtgattaattccgactccgaatgtttcgtgctcaagccccttaatcggagctccgatcgtgccgtaaagggaaacggcgatccaatcgccttccgcctcgctttcatacggatttccccgcaagacggcaaacttcaggcccacggtacgaagcagcgagccaagcagcatttcgccccgcgtcactccgtgcaaagcttccattgtggcatgatacagcgcatgtgattcgcgataaccctcagattgaatgacgccgctctttttggaagcggtttcaattgcagctaccaccttatgcgcatccattgaacccaccctgccgagacagactttccagccgtcccgttccagccggctgatctgctggttttcttcagtctcatgaagcagaagaaggacggacaatcgcccgatgcggcggtctttgtgtaaggtcatatatgcttcactcaattcttaaatattctgataactagtaactgttttttatattaagtgtttgcgaatcagaagtcaaaactttttttccagtctttcacaaatcagattgctattgtattaaagcggtacatcgggaagccggcgctgttgatcacatatttccgccatccgcgtcataaaatagagcgttgtcttgaaagcgttttaagaaaagaagagagcgaggagatttcagaaaatgaaaaccagtttctttcgtgtgtgcctggtctcagcagcggttatcgggttcactctgccgcaggcaaaagcccagcatcccgttttttcagaggtcagcgtgcatgatccgtccgtcatcaaaacaggcgatacatactatgtattcggctcgcatttggcttccgccaagtcgaaaaacctgatgcagtggcagcaactgtcttcaagcgtcaatcccaataatcccctgatcccgaacgtctactccgaattaaaagagacattcgactgggcccagtctgatacgctgtgggcgccggatgtggctcagctggctgacgggaaatattacatgtactataacgcctgtaaaggagactcgccgcgatccgctctcggtgtcgccgtgagtgacaaaatcgaaggaccctacaaaaacaaaggcatctttttgaaatcaggcatggaaggaaaaagcgaagacggcacgacgtatcatgcaaacgttcacccgaacgtcgtagatccgcaaacgttttttgaccataaaggcaagctctggatggtgtacggctcttactccggggggatttttatactggaaatgaatccgaaaaccggtttcccgctcccgaaccaaggctacggaaaaaaactgctcggcggaaatcacagcagaatcgaaggcccgtacatcagctacaatccggaaacgaaatattactatctgtatctgtcattcggcggacttgacacagccggcggctacaatatgcgtgtggcgcgctctaaaaatccggacggtccgtactatgacgccgcaggccataacatgcttgacgccaaaggaaaagacggcagtttcttcgatgacaaagcaattgaaccgtacggggtcaaactcatgggcggctacagcttcgcctcacaatctgaaaaaggcacgggctacgtttcaccgggacacaactccgtgttttacgacgggaaaacgaaacgatcatacctcattttccacacccgtttcccgaacagaggcgaagagcacgaagtcagagtgcatcggctgtacatgaacaaagacggatggcccgttgcagcgccgtaccgctacgcaggagaaccggatacacacatatcggcagccgccgcatccggagcctacaaactcatccagcatggaaaagacattacagctacgatcaaaaccccaaaaaccatccggcttaacaacgacggcaccatttccggggaaatgaccggaacctggacaataacgaacagcagcaaagcccgaatcaacctgaacggcacacattatgacggtgtcttcctgaaagaatgggactcagcgagagagaaagaagttgtgacgtttagtgtgctgagcggtgatggggaggctgtttggggagtgaagtgaaaaagcacctactccagtttggagggtgcttttttcttgctaattaggagaatgaccttctattgcttttaataaaccatttgaattatgatggactcaacctctatcgtttacagtgaacagtataaaattgataacaaaaatatgaatacatacctaagaaaaaacgaaaggaagtttaattttgaaaaaaacaataaaagtagccgccgcagttatacaaaatgaaaacaatgaaattctatgtgctctacgttctccaacaatgtctcttcctaatctgtgggagtttcctggtggaaagcttgaagaaggggagaatgctcgggaagcacttgtaagagaaattgaagaggaacttgattgtaaaattgttacgggcgatgtgatagctgatattcatcatgaatatgagaaggtcatcgtcaatttaatttcaataaaagcgaggattgtatcagggaagccggtagcaaaagagcatgcggaattcagatgggtgcctattcgtgagctagaatcactagagtgggcacccgctgatcttccgaccgtatctgctttaattcgttaaatccacatacaagttttctgggacaggctgatggagcttccatttgacattcattggcttgtctccgtggcttgatacgtaatccgcttctcctaaataaataaatggtaaagtgatgttgtgcatttcagtgaatttcctcacaaataaatgaatatggtatcctttttccttatggtgaataaagttttgccctacgcttgatatatgtgaggtttggttttgactttgccagtgaaaatggctaggatcaataaaataatctttatatagcaaatgatcttctactttttctgacttattcaaattgataaagattaaatagtgatttttaactctacgtacaccctctcgccaagtcccttcctgatcagttgactgaaaaagataaatgagctcatttcttgtataggtctgatacaatgttagcttaatctcttttgaagcaagggcttctatattgttcatacgtctaaattcaatcagtccatagtggacgcgctccttaatatacggtccgaataatggatcggttaaaatctcgcttacttctggatctaacttgaatgtatcaccttgtaatgtaccaaagcgccaattctgtttttgatctgatttcgttaaacgctccattgctcgctgaatgaggtcatcatgtgtatctgttgtgatttgaatatgaaactgtttttctaacgattcttttacatcttctattgtgatgatatttttgtgaaaaccgctctgtaaaattaaccattcataaggccatttaataggtaattgctgttctaatcttgctactatccctacaaccaaggggttattgagaatcccttcatctgtaacattcaaatcgtccattttctttttggtctgtacccacgatttgtatttctttataaaaaaggtaagcccaggtgcctgttcagagtatagaaaatcaattaattctggagagcgccctagctcttgtttaaattgcttgtataacgttttcagcatggcatctgaatttagtttaatgtgatcgatcttatttaaaatttctttcttcgttatggctgaaaggtcaacataagatcctccaggtaaatctgaaaactcatgcgtcacggccactcggagggaatctttatcaaaagatttttggcttgtttgtccagatagtgcgagtggaataacgaatgacttttgatagtttccgataaaatccagtatcgttacaaactctttgtcgtcagtttttctaagtccccgtcctaattgctgaatgaaaatcgttggtgattccgttggtctaaggaacaatagtagattgagctttgggatatctattccttcgttgaaaatatctactgtaaatataagttctaaactgtggtgcgggtcctctaattgacgaatgacctcttgtctttttgcaggagaatcatttcctgttaaataagttgtataaaaacccaatttattaaattcatcactcatgtatattgcgtgttcgacgtttgtacagaaacctaagccaaccattttctcgccgtggaatccatacatgttgatcatcttgatgatatattctactcgtttatgcgtttttaaatgattgactagcgatttctcttcgtacagtccgtttttcacttttactttttcgtaatctacagtatgatctgaaattccaaaatagtgaaatggcgcaagtagctctgcctttagggcatcgcggagtctgagttcataaacaacattatgatcacaaatctgaagcacatctttaccgtcaagacgctctggtgttgcagttaaacctaataaaaactttggtgtaaagtagtttaatacagcttgataggtagatgcttctgcatgatggaattcatcaatcacaatgtagtcaaactcatctgttgaaaaagattccaaagtatcttttttatgtaacgtttgtatagtgctaaataaaaaacgcttatctctttcttttttcgtgccagtcaataagccaaaatcttcatgattatttgtgactttcttgaatgtttcgattgcttttgaaagtaactcttcccggtgggcaagaaaaagatatttatttggtttaaattgctcaaaatcaaatgctgctaaaaatgtttttccggttccagtggcggcgatgatgactgcttttgtctccccttcgtttcttgtttttttaaggtttcgtaatgcttccttttgcatggcattcggggacattttcgttttgtaaagagagttttgagcagcaaaggaagcacttaccttttggcttccagcttggaattcctcataggcttgtaaaaattgttcgtcaacaggctgtgtcttttcattccaaacagtgtcaaacaaatcttttgtttgttgataaacggggagatatctggtttcaggtagtctcacatttaactcatacccagtcgtaagggcagcttgtgatagatttgaagatcctacaatgacactatgctgtccagaacagcgttcaaataagtatgctttcgtatggaaagattttttatattcatttacaattctcaactcaacattttcaaattgaagaagatgtcttaacgccttcggttctgtaatacccatataggtagatgtaatgatgcgtacagggacatgtcttttagcaagctcctgaagcggagggatcaaaagctgaacaccagaccaccttgtgaaactaaccataaagtctacccgatccgccgttaacatttcgtgttttattgctttgaaaaagttctcatgagtttgatgatttcctagcagtttcagacgatgtagagaaaattcctctgaaataggaagttccatttcatttaaactataaagcactgtggaaagtggcaatgaaaaattcgtatgttttccaagctgagaggcgaccttctcgctcagctgaatcgcttgttcatattgatcttgatccacaagtgtttgaaatgtctcgctcagttgttttgccgtatgtaaagtcaaaacttctgcatattcttttgggctgaccggttgaatgcgatgtgatgttggataaagtttttgttgttgctgaatttcctcatggaagcctctatgatttctcatcataatctccttttttatatcaataattccattttatcactacttttaccaataggtaatactgaaaaagaagagaataaagtcctatttattaagcgcttaaaaaataacgctgaggtagtttggtttggtataaagacgtcatcgccacaaacggagaaagtctgtaagcgcaatgttccggagaaagccggcaaaattgacattcagcaaagagaggaggacaataaaagcagaaaggcgggattcatatgtttaaaaaaattcttgcagcagtagacggttcagacatgagcagcaaagctttggacgcagcgatccatctggcgaaagaacagcaggctgaactcaccattctttatgcgggacgtgaagccgttgtctccacatcagccttaacagggattgtctatgttccggaaaacttcattgaagacatcaaacatgaagtcgagcaaaaaggagcggccattctggaaaatgccaagcagaaagcggctgaaagcggggtaaacgcggaaagcctgtacgtccaaggcgaacctgcgcatcaaattttaaacatagcgaaagaacagcatttcaatctgattgtcgtcggaagccgcggaatcagcggatttaaagaaatgatgctcggaagcgtgagccataaggtctcacaattgtctccttgtcctgtactgatcgttcattaaacagaagaccctgctgatgcggggctttttttaatgagaaaagaccgccgtctttcgaaaaataggatgaaatcttcctctgaatcaagtaaaatggctgttagtatttgtctgaataaacagtcaatgatatgggggaagcaaatcaatgcaagctgaacaaacatcaaatgccgtcatcaaaatggtcatttccatggtcattttcggatcaatcggctttttctcggaacatacgaatgttccttcaattgaactggtctttgtgagatgtctgtgcgcctctttgtttctgggcgtttgctggtttggttccggacggcaccgcaccgaacaatggaaccggcgcgaggtgttgcagacattggcctgcggattttttctcgtgctgaactgggtgtttttatttaaatcgtttgaggagacatcagtgacgatagccatttccgtttatcatctggctccggttctcgtccttcttctagggagccttatataccgggagaaactgcatattgtgtccgtcacttccatcgtgatttgttttctgggcaccgccctgatttccggcatcaacggaaatacgtcattttctcagctgatgggatcgggtattatttgggccgtgctggccgcccttttttacgcctttacgacactggccgggaaaggtatcaacagtctcagcccatatgcggtcacctgtttgcagaccgggttgggcgttatcattcttctcccgttcgtccgtttcggcgctttttctgatttgtcgcatgtgaactggatcatgattgtgtcaaccggtatcattcatacgggaattgtgtatttgctcttttttgacagcttgcggtttttatccacccggtttatatcaatcatcgtatttcttgatccggcggtggcgattgtgcttgacaccgtatttacggggtttcgccccgacctttatcaatctttggggattgtgttgatttttgcgggaatggcactgtccctgattcgaaagcaaaaagccgtgccggcggaaactcaggcagacagcacccgtatataggcggccgtatcggctgctttttttgttttggggcttttcagccataacgaaaaagcagacaaacagatcatggaaaaagaggatagtaattgtataatacttcatgtgtttgcaatttaagagattaaaggagtgaagggcatgaaaaagaagacgcgtcatctcgctttcttggctgcactcggctttgcgctttgtctggccatcgtatgttccgcatccaagcaggcagaagcggcagcggcttatccggatgtgatgcagggacttaccggattcgctggcaatgcgaaggatcataacggaaaagcaaaatccgccgtatcgggaggccagggcggccccgtcgtctacgtcagcaatctcaatgatctgaaaaacaatgcgggcggaacggaccgcaaaaccatcgtcatcacaagtgatatttcttccccggggaaagccgttgtgacagtcggcgccaataaaaccatcgtcggctcttataccagccacaggctgaccaacatctatctgaccaccggctccggatcaaacaatgtgattttcaaaaatctcattatcagccataatgccgccattacaggcaacaacgacattccgatgtacatagcgaacgggcagaattactggattgaccacgtgtggtttgaaggacacagctacaatccgaacagccacagcgatttgggaaagcttctgtatgtcggcgccaaagcggattttgtgacgctgtctaactctaaattcacagaccatctgtacggcctgattctcggttatccgaatgatgataacgaaggacgcaattatatcggctatccgcatatgacgatcaccaacaactattttaataacgtctatgtgcgttcaccgggcctgatgagatacggctattttcacgcgaaaaacaactatgtgaccaatttcaatttaggattcaccattcatacaaacgcgactgtcttctcagaagccaactatttcggtaacggaaatgaaaaaggcggaatgatagacgactacgggaccgcccaattcaccgacaccggttcattcccgtcgctcaaagccccgaaatcaccgcgcaccggctggaatccgagatcaaattacagctacggcacgctttcagcccaggacgccaaaaacttcgcccaatcctacgcgggagcgcaaaatacaaatctccgctatccataatacaaaaaaccgccggcagccggcggtttttttatatgaataaaaggttcaaaattcctataatccttaaaataaccttaaatacctaggaaaatattgataaacaatttcaataatattactattgttaagcctatattacaaaagaaggaggagaacctatgaaaataggaaaaaagaacaagtggaaaaaatggctggccggcactcttgcggcaacgcttatgatttccattgcgcctgccgatgtatttgcggcagaaacgcgtgaaaaacaagatcaagcgaaaaccgccgccattccggcagcagacccggaaaaagatcttccggcggaaaaagcatccgagcagatgccgtttgatcaaaaagatatcaatcaagacggtgagatcacgtctgaaagaactgagaattcaaaactttattatgagggcgagggtgtatacaaacaggaaatctacacagaccccattcatacgaaagaaaccgccaatgcggactgggaagacatttctcctgaattgaaaaccggctcaaaggatgtcgggacggaaaatacagtgctgaactccgattttctgaagcaaatgaaaaacggattatacgctacatttgaacacggtgatcataagctcacatactcattaaccggcgcaaaaggccccgatcaggctgcaatcactccgacagatgcctcagcaaaagtgaaggaagacagcaacgagcttacgtatcagcaagtgtttcctgctattgatttacaaacctacacatttaacgaaaacataaaagaagaccttgtgcttcacaaatatgaaggctacaattccttcacctttcaaatcaaaaccgaccttcaggctaaagaacaggaagacggctcgatcgcgttttctgatgacaaagacaatgtcgtctacaccgtgccgaagccttttatgaccgactcagatctcgacgagaagtcaggtgaggtcagcaggtcagaagatgtcagcttcaagcttgaaaaaaacagcgaaggctacttgctgcatgtaacggccgatgaaaaatggctgaaagatcccaagcgggtttatccggtatctattgatccttccacatcagtatccgtgtcatccgatacctttgtcatgagtgcgtacccgacgacaaactactctgccgcgtcgcagaaatgggaggccggattgaaagcgtacgtgctgaaaacaggttattatgacggcacaaccggaacgaactacgcatttatgaagtttgataatctaaagccgatcaaaaacatgacggtgacaaaagcgacgcttaaagcatacacagcccactcctattacggatcaaaggcgacggggctttggctcgacaccgtaaacagcaattacgacaatgccaagatcacgtggaaaaacaagccgggctccaaaaacatcggcaaagccgaggtctataaaggccaatgggcaagcttcgatgtcacatccgcagtcaagtcgtggaacagcggcggcgccaattacggctttaagcttcacacaaacggcaacggaaaagaatattggaagaagctgatgtcatcagcaaactctgctaaaaaaccatacattgaagtgacatacacgattccgaaggcggacacgccgtctgtcaaagcgtatcataacggagattcgacaggacttttcaatatcagctggaaaaaagctgaaggcgccaaaagctataaagtgtggctttataacgggaaagaatatcaagccatttctgtcggcaatgcaacctcttggagcacaaaaggaaaaaacatctggccgacaaaagcagaaatcgactccggcaaatataagctgcatacagacggaaaaggcggaagtgaattagcgcttaatccttcgccggtctataaaaactccggcggcagctatccggcaagtaaaaattactgggtcgcggtcagcgcggtgtttgaccagggagaaggcgccatgtctgcggccgccaagcccgtcattccgaatattggcagagttcagaaaccaagcacgaaaggctttaataacaacaacgccacaggctggtttgatctttcctggaaagccgtatcaggcgcagccgggtataaaatgcaagtctttaacggcaaaagctttgaaacgcttgacctcggaaataaaacatcctggtccacaaaaaatcaaaacatctggccgacaaaggcggaaatcagcgccggaaaatatgcgcttcacctgaaagacaaaaaaggcgcggaattgccgatcaacccgggccccgtttataaaaatgccggcggagacgcaaaccggaaaacatacggatttaaagtaatcgcctataacaaagacggagaagcgatcgcctcaccggaagctagtccggcgctgcctgatatcgcaaagccgaaaaatctgacaggctacgtctatacgaacacgaaatcgagccaaacgggttatgtcaatctcatatgggataaagtcaaaaacgccaaaggctacaaaatcaacatctacaacggaaaagactatcaatcattcgatgtcggggataccgatcattggacgacccaaaacaaacacatctggccgtcagccgatgaagtgaaagcgggaaaattccagcttcacacggacggaaagggcggcgaactggcgcttgacccttcacctgtttacgaaaacgcaaacggcaattacaaagggaagaagaactattcctttacgctgaccgcctatgacgcaaatggtgacagtataccgacggcaccttttaaccctgttttccatgaaggtgcggaattcctcggaacggaagaattctggtctattatcgacattccggacggacagctgaacggcgcgacgggaaatgtcatcgtcaatgaagaagatatgtcaatcgacggacgcgggccggggctcggactctcccggacctttaacagccttgacagctctgaccatatgttcggccaaggctggtatgccgatgcggaaatgtcgattctttctgaagacggcagagccgtttatattgatgaggacgcgacaacacatgtcttcacgaaaaaatctgacggcacgtatcagccgccgacgggtgtttatctcgaactgacagaaacaagcgaccaatttgtattaaaaacaaaggatcagacgaacgcttatttcagcaaaaaaggcggcaagcttcaaaaagtcgttgacggacacaacaacacaaccgtatacgaatataacgacagcaatcagctgaccgccataacagacgcatcagggcgcaagctgacatttacctatgatgaaaacggccatgtcacatctcttacagggccgaaaaacaaaaagatttcgtattcatatgacaaagaccttctcaaaaaggtgacggatactgacggcagcgtcacaagctacgactatgatgccgaagggcgcctcgtcaagcagtattccgcaaacagcacggatgacaaaccgctgttcactgaataccaatacagcgggcaccgcctggccaaagccgttaatgcgaaaaaagaaacgtatgattacagctatgacgccggcaaaaaaacgctgctcatgacgcagccgaacggccgcaaagtgcagtacggctataacgaggcgggcaacccgattcagatgatcgatgatgccgaagggctgaaaatcacgaccaacactgtatacgaaggcaacaacgtcattcaggacaccgatccgaacgacgcggatgcgggcaaagcgacagaaagctatcaatatgataaagacggcaacgtcacagccgtaaaagacaactacggcaccgaaacgtatcagtacaacaaaaacaatgacgtaacgaaaatgaaggataccgaggggaacgtcactgatattgcgtacgacggacttgatgctgtttctgagacggatcaaagcggaaaatcctcatccgccgccgtgtatgacaagtatggaaatctcattcaatcaagcaaagagctggcagcttcggcaagcctgctgaaagacggcagctttgaagcaacaaagctgggctggaatctcaccgctacgagagacagcggaagcatcgcgtctgtaaaagcaagaagcggcgcgctgtccggacaaaaagcactggagatcacctcacaatccgcttcagccggaacagagcacggccatgcgtccgcaacgcaggaagtgcagcttgagccgaatacgacgtatacactcagcggccagatcaaaacggatctgacaaaggcgagagcgtatttcaacattgatctgcgtgacaaagaccaaaaacgcattcaatggattcacaatgaatcaggcgcattagccggaaagaatgactggacgaaacggcagattacctttacaacaccggccaatgcaggaaaagccatcgtctatatggaagtggatcataaagacaaggacggcaaaggaaaagcgtggtttgatcaggttcagctggaaaaaggcgaagtctcttcaagctataacccggttcaaaacagcagtttcacggctaaagcagatggctggagcacaagcggagccgccgctgaccttgatgaaggcttcgatgatgacagctcattaaaagcgtcccgcacaaatgcatcacaagccaatgcggccgcaaaacaaaccgtcacattaggccaaagcgcggacgataagccggtatatatcacgctgacagggatgtccaaggcagacggcgtaaaattaacgaacgacaatgattacgcgcttcaggccggcgtcacctatgcggacggcacgacgggcgtctacaccgccaaattcccgcaggggacacaggaatggaaccgggcggcggcagtcattccgaaaacaaagccgatcaataaaatcgaaatcagcattctgttccaaaaaagcgccacaggaacggcgtggtttgatgacatccgattaatcgaaggaagcatcctgacgaaaaacacctatgacgaaaaaggaaactacgtcacaaaagaagaagacgaactaggttatgcaagcactgcttcatatgacgagactggcaagaaaatgtctgaaaccgacgcgaaaggcgaaacaaccgcctacgaatacgatcaggccgaccagctgacaaagctgaccctgtcaaacggcacatccatccttcacagctatgacaaggaaggaaatgagctgacaaaaacgattcgggccggcgcaaaccagacctatcaatatgaatatgacgtcatgggcaagctcgtcaaaacaaccgacccgctcggcaatgtactgaagagtgaatatgacgccaacagcaacctgacgaaaaccgtttccgccaacggcaatgaagtgtcgctgacctatgacggcaccgaccgggttaagtcaaaagcgtataacggcactgaaaaatacaactttacctatgacaaaaacggcaatgaaacgtcggtcacaaacaaagaacaaaatacaacgaaaaaacgcacctttgacaacaaaaaccgcctgaccgaattaaccgaccgcggcggcagccaaagctggacgtatccggctgattcagataagctgaaaactttctcatggagccacggcggccaaaaaggaacaaacagctttacgtacaacaaacttgatcaaatgattgaaatgaaagacggcacttcagcctatacatttgattatgatgaaaacggcaatgtccagacattcatcagcggaaatgaagtcggcacgagcttctcatatgatgagcggaatcttgtcagctctcttcatatcggagcgaaaaacggcggcagcatcttccgggaaagctatgaatacgacgccaacggcaaccgcacggtcatcgacagctcagccggcggaaaggtgcagtacgaatacggcaagctcaaccagctcgtcaaagaaactcatgaagacggcaccgtcattcaatatacgtacgacggcttcggcaaccggacaaacgtcaccaccacaaaggacggcgcaagcaaatcagtcaacgcatcattcaatatcatgaaccagctgacgaaggtgaatgacgaagacctgtcctatgataaaaacggcaaccgcatatctgacggcaaatacacatatacgtgggacgcggaagacaacctgaccgccgtcacgaaaaaaggcgaagacaagccgttcgcaacatacaaatacgatgaaaaaggaaacagaatccaaaaaaccgtcaacggaaacgttacgaactacttctatgacggagacagcttgaacgttctgtatgaaacagacgccgacaacaacgtcacaaaatcatatacgtacggtgacagcggccagctgttatcctatacagagaacggcaagaaatatttctatcactacaacgcacacggcgacgtcatcgccatctcagacagcaccggaaaaaccgttgccaaatatcagtacgatgcgtggggaaatccgacaaaaaccgaagcaagcgacgaagtaaaagacaaccgctaccgctacgcaggctaccaatacgacgaagaaaccggcctgtactatctcatggcccgctactacgaaccaagaaacggtgtattcttatcactagacccagacccgggcagcgatggggattctttagatcagaatggatatgcatacggaaacaacaacccggtgatgaatgttgatccagatgggcattgggtgtggctagccattaacgccggctttgcggcttatgacggatataaggcatataaatcaggtaaaggatggagaggtgcagcctgggcagcggcttcgaactttggtcctgggaagttatttaagggtgctaatcggatttataaagctgctaaaacatataaactatctagaaaaagtgtacgggctagaagggcctactcaagttatagggatataactggaaaaacttctaggttcaaaaattattctactaatgtaaaaagaagaacttttgaaaaaaatttaagaagacaaggatggagaaaatcagttcatcatgggggtgttatcactatgacgaaaaatgggaataagtattccctaaggaaacatgctaagtcaagtccctatccaaccgcggaatatacacctaaaggtagaaaaaaattcacacacaaaatcagaatgcgacattaaaggggaaataagatggatcactattttattgatcatcctaaggagttaaaagtctatcaatccataattaattccttatgtcacgtagatcaaacattgcctaaacaagtttttaagcaaaggaaaaattattatttattcgaggaattccattgggtattatctgaagaaagttggggaatgtttaagagtttggctaatgaacatcatgatgagtttatattaatggctgttatagacagttctgaacatataaaccaattctacgaagaatttgagtattttaactggataaagatccctttgcatataactgcagatgagtatctgtcactcttaactgattatccaaagcacagtaaaagtgactgtataatgaatattgcatctcgtgttgtttgggcttcaccgactttaaagtgggcgatttatggtgagagagaacttgaaatctgtattctaggtattgatcatcagagtgaaggaaaagaactagcaacttggagatcgttagatggcgttgtcttagattggatatcagttgtattcccaaatcagacggttccagttgaatttgaaaaaacacttacggcacattacaaataagtatatttttaatacctactaccgatatcatctgattgttctaaacgggatttcaaataatctccagatagtatttttgcattcaacagatatttaatgacaaatatgcagagtaatatatttttggggcttgtttgaataatctatgtttatcatcaagacacttctatcaatgggtttgttagtgttagttaggagaaggagaagacaatgcacaaacaaattgaacaatagagtagattatattgacgagggatgtaatattttaaaggtcgattatcagttctttaaaaaagacctgttttaaggttcaggttgttaaaaatgcagcatctgtttattttagtgcagatattggtgatatgagattagaaaaaatagattcggaagaatacaattggcaagtatttgagatgagttaccacccggaaggaatcggtaatctatcaaatgctgtaattccggagtatcaatcaaatgctaattttctcattgacatgaacagaatgctgattgctgtagaagctgaaacagttcgctttgacgaccaatcattttatgcgtatcatccgaaatcataaataaacaaataagagaggttcccagcctctcttttcttacataacgaaatcgttcgcggaggcaaacatgaacactcctttaaatttacaaaaagaatcattgagggctatagggaatctggatgtgattaatccgcttaaatacaattcgatttattcatgtgatctagtgagtaaagatactttttctcaaattaatgaatgacttagagttcgaaacagctctaatagaagtaatggcattcccttcttttattgaagaatggaagaagaaggttgaaaagaaaatgataaatatgaatactgtatcgaaaaagttcattcatattgaatgtgtcctaaccaaagaagaattgatggcagattacttattagatgaattatattttttagcatcgatcaatgattttgttgttataatagcaaaccctgccaaaaataagtcctgcatgaacctgaacactcaaaaggttgatgtaactactgaaagtaatgaaaaaatcatttggtttgaatacgatgcagcagatttatatatcattgattaatttaatataaatttcaggttcctattcaacggagtgttgctgatgttaaaacttaccgcggagcgtgttgggtcatatgaaagggaaaatatcatttatttcaatgcgggtcgggatgatcaagtatttattgtgtcggtgcacgatcacaaagtaatattggaggttatgaaaggcagctctcttttaatcaaaaaagagttacacggattttctgaagatgcccatttctatctgattgattcgtatgatgacactatcgtgatcgtttacctggagaatcatacgtgtcaattggctgcatactgcgtaaacagtaataaaatcaatccgatttgttcttttctattaagcgccaatgtatttcatctgggtgaggatggattattatggatcggattaacggacgagggtatgtatgatgagagaaatcctcaaggaaaagcgatatttgcttttcatgcagaagacagaacgttttattttgaagacgattttaaagaaatgatgcacgaatgctatgccgtacaatcgatcaaatctgatttgtatgtatgtttcgagggagaggattgctgtgtcatcgggcattatcagattggacgggacagaattcgtactgttgcagaatatgtgctggacggcgatcaatactcctattgtgatcagctatccgtttcgaaaaaaagggtgctgctgattcagagtcacgatgataccctatttgcatttcatgaagagcacaaagagactgacgtcatgatacacggtattgatagaaaaggagaaacaacgtacagagccgtacaggatcgcatgtttatctttagtgataacgatttatatctggtaaagtattgatcaatcctatgcagatggctttttacagccatctgcatatcattttacggagtgaacgatcgatataaataggataccatccaagactcaaggggcaatgacatgaaaataaaaatgaataagatagtcgaagaatcagtaaaaggatgtttttgtcattttgataactgcgggcgtctgtatctcggacggcatcagaatggcgggctttcgtttacgatcatcgacaaatcgggcgatacgcgagtgattcatatcgatgaacaaatcccgtatgaggatattatgctgttccaacagagttcggctgactggtatgtgttgattttctttgaatcgcatgagtataaagtgaaagtattttcagcagaaggaacagaacaaagtgcattttctctcccttcaggggtttcatgcagtcttttggatgaaaaacaaaacctgtggatcggtttaagtgatgaaggtatttatagtgatgaaaatcctgaagggcacagtgtgctgtgcttcactttagacgggcagctaaagaaaacccacattgatcagcagctttcagaaatatatgcgcccgcggtagatgactgttatgcacttgcagaaaaagacggactaatctacatgctgtattacgcttatacagtcattgctgcgtttgaagaaaccgacgtgaaacgagtgtggattatttctgataaagcatattccggggtttacgaccagctagcgatttcagataacgggttttgggtatgcaaagatgatcattcactgtctctcattccggccgatgtcagtctgccgatgcaagagataacgtgctgtgatgcggatggcgatgagctttccgggcatcagctgaagctgactggcgatgccatttacgcggtctcgaattcagggatttataagcgggatatcagtaatgggaaagcggctaaatgagatgttaagatccaacagatattctttaaataatgacgtcatcagaagcttgaaattacacaaaaaagaattagaggggccgctgccttcagatgcagggagattcgaagaagactttgagggtgctgcctgcgctggggatttttatgaatacttcgcacttgtctgcggcagcttagattttgttttggcgaataaacaaatgcctgcacggcagcgtaaagccttatataaatccttttttgagctgtatccgcaatatgcgcagctgaaaaacgctttgatggattatccggagctcagccaggaaatcgggcggcacgaacgggccaggaggctgttagtcagcattttaaacaagaaatgaaaggcaggattttgacgtgaaagaacccacaagagcagaatgtctgaaaaaggctggtctgatcctgaacggtcaagcggcgagggaagaagtgtcggattgggcgtctgagtatgtgagtgcaggtgatccggcggatgaggacgaaaccgtttgggagatgctcgtatatttgagcgggtttgatctgaaagattcgcctgatgcgtatctgcatacgatagaagaattaagagattgggtgcaggaatataaagaagttcatggggatttgtaagaaaaaaattcatttgagtcagacatgtcaattcagctgaaaaaaaggaggcgcaaaatggaatggcacaaacatgagaaagcagttctgccggggccaggttcgccgggttgttttgaattgacggagtttacgttctataccgggtataacgagtattatgataaaatcccggtgtttgagctgaagctgactgacggacagtatgatgccgtgctgcggtttgaggatgtgaggtctgcccggctggatgatcttgaaagcatcaccgacatccatctggatatcagcccagtcgacggcggctgggaatcgatccgctactatgtcgatgacggggaaggaagtatgagcttttattgcgccaaatgggtcgtgctcgacatgaagaaaaagcagtcccccgaacggcccggcaaaacgtcagggtaaagcggcggcatttcgcgtataatgaggggagccggacagagaaggagtttagtcatgaatgagtttaatgaatatgcgatcagccccgagatccgacgggcgctgaatggcttgcaatacaccgagccgactgaagtgcagcggcgcgtcatccccgccgcgctgcaaaaaaaagacctcgtcgtcaaatcgcagacgggcagcggcaaaaccgcggctttcggcattccgatctgcgagcttgcggagtgggaggaaaacaaaccgcaggccctgattttaacgccgacccgcgagcttgcggcgcagattaaagaagatatcacgaatatcggccgtttcaaacggataaaagccacggcggttttcggaaaagcttcttttgacaaacagaaaaccgaactgaagcaaaaaagccacgtcgttgccggaacgccgggacgtgtgcttgatcacatagaaaaagggacgctgccgcttgaacggctggcgtatgtggtgattgacgaagcggatgaaatgctgaatatgggatttattgaacaggtggaagccatcattcagcatctgccgaaaaacagagtcaccatgttgttttcagcgacgctgccggatgacgtcgagaagctgagccgcacatatatgaaagaccctgaattgattgaagtaaaagcggaaggcctgacgacaaaagacattgagcattttgtcaccagaacagaagaagaggataaatcatctttgctgcgtgatgtcctgatcaccgaaaacccggacagctgcatcatattctgccggacaaaagaaagggtcatccagttaaccgatgagctggacaggctgggctacccttgtgataaaattcacggcggcatggtgcaggaagaccgctttgacgtcatgaatgaattcaagcgcggcgagttccgctatctcattgcgaccgacgttgccgccagaggaattgatatcgaaaacatcagcctcgtcatcaattatgatattccgcttgaaaaagaaagctatgtgcaccgcacaggcagaacgggccgcgccggacaccgcggacgggccgttacgtttgtgacgccggctgaatcgcggtttctgaatgacattgagacatatatcggtttccgcatccaaaagcgggaggcgccgtccgagaaagaaacagcggaacggaaagcggcttttgcggaaaaattgaacgcccgccccgatgtcaaaacagacaaaagcgaacagttaaacaaagacatcatgaaactgtactttaacggcgggaaaaagaagaaactcagagcggtcgattttgtcgggacgatcgcgaaaatcgacggcgtttcagccgatgatatcgggattatcacgattctggacaacgcaacatacgtcgaaattctgaacggaaaaggcccgcacgttcttgacatcatgaaaaatacgacggtcaaaggcaaaaaactgaaagtccataaagccaagaaataaaatagaaagcctgccgcgtgcaggctttttttacgccgtttcctcaggcacaaacgcaaggatggcaatgccgatcacaaataacaaaatcaggctgaacacggcggctgacgaatttccggtcagctgggcggtgacggcaatcaaaagcgggccgataatcgaagcgaacttgccgaagatattataaaatccgaaaaactcattggcgttctgtttggggacaagctttgcaaagtaagagcggctcagcgcctgaatacctccttgggaagtggcgacaagcatagccaaaacccagaaatcaaaagcggaatccataaaataagcatacgtgcagacaatcatatacacgccgattccggcataaagcattgtttttcctttaaaccgttcggccagccgctcgtacaaaatcgaaaaaggggcggcgacgacctgtgtgacaaataaaacaatcagcagatttgccgcgctgatgccgaggtcagccccgtatgacgtggacattgtaatgatggtgccgaccccgtcgatatagaagaaataggcgagcagaaacaaaaacagcgcccggtgcttcctgatctgcttcagcgtgccggccagccgtataaaactgctgatcacaagccgcggctccctctcgatataatagcgctggcggacgcggagaaggagcggaatcgaaaacagtccccaccatgccgccgtaattaaaaaggcaatgcggcccgcagtctgggcggacagcggaatcacctccgcttgtgctgacagaatcacggcaatgctcaggagaaaagggattgtactgccgatatagcccagcccaaaccccctggcggacaccatattcatccgctcctttgcggccacatcaacgagaaacgcatcataaaacacattagatccggcaaagccgatcgtggaaatcgtataacaaattaataacagcatccaagattcgccgggaatcaaagccagcgcggcggtgcccgccacaccgatcagaaaaaagaaggcaaaaaaccgtttcttgcatcctttgtagtcggcaatcgttcctaagacggggctgagcatcgccaaaataaaagtcgcggcggcaatcgtatagcccaaataagcggtggaatcagctgcgctgacgccgttttccgccgccgccgctttaaaaaacaaggggaacaccgccgtcataataatgaccgaataagctgaattggcccaatcatacagcatccagctgctttcttctttcgaaaaccgtttcatcacacacgctccttcccaaaaaccggttctctgcattatatgcgcctctgcctcatcgttggacaatgatttctgaacggcgttttctgattgacctggagatattgacctggtacaaaaaggatgtacaatcaaggtgtagcaggtaaatggtcaggcgggagggagacggaattgaagattgcgaaagtcaataataataatgtcgtcagtgtgctcaaagaaggcaatcaggaattggtcatcatgggccggggcattgcttttcaaaagaaaacgggagatccggcagatgaagcccgcattgagaaagtgctcaccctcgataacaaagatgtatccgaagttcaaaacccttttgtatgatattccgatcgagtgtatgaaagtatccgaggagattatcagctatgcgaaattacagcttggcaaaaagctcaacgacagcatctatgtgtcgctgaccgaccatattactttgccattcagcgcaataagaaagggctggatatcaaaacgccttgctgtgggaaacgaagcggctctacaaagacgaatttgcaatcggaaaagaatcgctgatcatggtaaaaaacaagactggcgtgtctctgccggaggatgaagcaggttttattgcgctgcatattgtaaatgccgagctgaatgaggagatgcccaatatcatcagcattacaaaagtcatgcaagagattttgagtatcgtaaaataccattttaagattgaattcaacgaagaatcgcttcactattatcggtttgtcacccacttaaagtttttcgcgcagcgtctttttaacggcacacatcgactttttgctggagaaaaataccgtcgggcgtatgaatgcacgaagaaaatccaaacttgcattgagagggcgtatgagcacaagctcaccagtgacgagctgctgtatttaacgattcacatagaaagggtagtcaaacaagcataatgaaagcgttggcattattgttcttggattcattttttcttacattcacatatgatcttgttaggattgttgctgataagcatgcaaaacctaaattacaatgagcgcggatcatttctgtttgtgctgatggtaatttaggtttttttaagattcgttattatcattattctgaccgatgttcccttttaacagaatcatgtatgatcgataaagaaatcgctctcaaagaaaggggaatgccgacatgttttatcgtatgaaacgagtgctgctcattcttgtcactggattgtttttgagtttgtgtgcgatcacttctgctgcatcagctcaaacaggcggatcgttttttgaaccttttaacagctataactccggtttctggcaaaaagcaaatggttactccaatggagatatgttcaactgcacttggcgtgcaaataatgtatccgtgacgtcatcaggtgaaatgcgtttggcgctgacaagcccgtcttataacaagtttgactgcggggagaaccgctccgctcaaacctatggctatggactttatgaagtcagaatgaaaccggctaaaaacacggggatcgtttcatcgttcttcacttatacaggtccaacggatggtaccccttgggatgagattgatatcgaatttttaggaaaagacacgacaaaggttcaatttaattattatacaaatggcgcgggaaaccatgagaaggttgcggatctcggatttgacgcggccaatgcctatcatacgtatgcgttcgattggcagccgaactctataaaatggtatgtcgatgggcaattaaaacatactgcgacaagccaaatcccgacaacaccgggaaagatcatgatgaacttgtggaatgggataggtgtcgatgactggctcggttcctacaatggtgtaaatccgctatacgctcattatgactgggtgcgctatacaaaaaaataatgtacagaaaaggatttccgccagcggaaatccttttttaattaaaacgaaataatcccaatcaaaagcgccgcaatcgtcatcacaatcgttgttcccacggcccatttaatagtgaatttttgatggtcgccaaagctgacgcctgccattccgaccaatagataggtggatggcacaagcgggctgagcagatgcaccggctgtcccagcaaggaggctcttccgatttcagcggcgtctattccgtaagcggaagcggcttcggcgatgatgggaagaacaccgaagtaaaaggcgtcattcgacatgaaaaaggtgaaaggcatgctggcaatcgccgtgatcaacggcagatgcggacccatggcatcagggatgagggaaacgagagaatgcgccatcgcatcgaccatttttgtgcctgagagaatgcctgtaaatatgcctgccgcaaacaccattgagacaacgtttaacgcattacccgcatgcgccgaaatccgtttctgctgctctttgacatttggatagttaatcatcaaggcgatggcgaacgcgatcataaaaagaacagggatgggaagcaggctggtgatcagcgcggccatcagagcgacagtcagcagcaggttaaaccactggagagcgggacgcttcagcggcgccgcctccggatcagaagacggcgcgtgttcaatcgaaatgatgccgagacgcttccgttctttttttccaaggagataagcaacggcgatcacccagagaacgccggcgatcatagcgggaatcagcggcgtaaaaacttctgacgtgtccaatttcaaggaagccaaaaccctcgccgtcggtccgccccacggaataatattcatgacgcccgaaccgagcatcgcaatccccgccagcaccaaacggttcatgccgagccgtttgtaaaggggcagcattgccgcaatcgtaatcatatacgttgttgtcccatctccgtccagcgaaatggtcatcgtcagaaccgctgtgcctacggcgatttttaacgggtctcctttgacaaacgataagattttggcaatgagaggatcaaacaggcctgagtcgatcataatgccgaaatacaggatggcgaataacagcataatcccggtaggagcgaggtctgtaacaccctgaatcatcatcccgccgagatctttgccaaatccgctgatcagggcaaacacaacaggaacgacaatcaaagcaataagtgcggaaagccggttagacataataaggtacataaaaacaatcatcatcacaaaaccgagtatggcaagcatgatatgacctcccctgttcaacagctgttttggtaagcgctttcacattttgtttctgtgaaaatggcttatttcaaaatgtgtatgaccgcatatgtaaatacagacctaaaatcctaatgagcggatcagcagtttatttaaagaacgccgcgggtaaatgtgctgtagaatgtttcgttttaaaagggggaactgacatgagtgatgatcaaaacaaacgagtaaatgaacactcaaaggacgaacagctggagcagtaccgatctgataacagcggcaaaaaaatgacgaccaatcaggggcttcgcgtgtctgaggatgagcattccttaaaagcgggcgtccgcggccccacgctgatggaggattttcattttcgtgaaaaaatgacgcactttgaccacgagcggattccggaacgggttgttcatgcacgcgggtacggcgttcatgggcattttcaggtgtacgaaccgatgacggaatatacacgggcgaaatttttgcaggacccgtccgtcaaaacacctgttttcgtccgtttctcaacagtggcgggctccaaggggtcagctgacaccgtccgtgacgccaggggatttgcgacgaagttttatactgaagaagggaactatgacctcgtcggaaacaatattccggtgttcttcattcaggacgcgatcaaattcccggatctcgttcacgccataaaaccggaaccgcacaatgaaatgccgcaggctgcgacggctcatgatacgttctgggattttgtcgcaaacaatcctgaatccgcgcacatggtcatgtggacgatgtctgaccgcggcatccctcgaagctatcggatgatggagggcttcggcgtgcatacgttccgtttcgtcaacgagaaaggaaaagcgcgctttgttaaattccactggaaacccgtgctcggcgttcattccctcgtatgggatgaagcgcagaaaattgccgggaaagatcccgatttcaaccgccgcgacctatgggaaacgattgaaaacggcggcaaagtcgagtatgagctcggtgttcagatgattgacgaagaagatgaatttaaatttgatttcgatatccttgatccgacgaagctgtggccggaggagttggttcccgtcaagctgatcggaaaaatgaccctcgaccgcaatcaggacaatgtctttgcggaaacggaacaggtcgcctttcacccgggaaatgtcgtgccgggcattgatttcaccaatgatccgcttcttcaaggccggcttttctcttatacagatacacagctcatccgtcttggcgggccgaattttcacgagattccgatcaatcggccggtctgcccgttccataacaaccaatacgacggctaccaccggatgacgattaataagggccctgtcgcctatcataaaaattccctgcagaacaatgatccgtcgccggcctcagaagaagaaggcggatacgttcattaccaggaaaaagtagaaggcagaaaaatccgccagcgcagtgagagcttcaatgactatttttctcaggccaagatgttctggaacagcatgtctcccgccgagaaagaacatatcatctccgcgttctgttttgaagtcggaaaagtgaacagcaaggatgtgcagcagcaggtggttgatgtcttcagtcacgtcgacgccgggcttgccgagcgtgttgcgaaaggaatcggcgtgaacccgccgccgaaggaccgtgaatctgatgaaacgttcacttccccggccttaagccaggaaaacacggtgaagacggcagcgacaaggcaggttgcggttttaaccgaccacgggttttctgatgagaaagtcaaacaagtgcttgacgcatgcaaacaggcgggagtcagagccgatatcatcagtcctgtgcttggaaccgttaagggagaaaacggcacggagctcgaagcgtcagccacgttcctgacagcggattccgtcctgtacgacgctgttttcattccgggcggaaaacaaagcacagacagcctcaaagcccaaaaatcggccagagacttcgtcaacgaagctttcagccattacaaagcgatcggcgcctccggtgaaggaaaagaacttctcgccctcgccgccggaaccgaaagcggccccggtcttgttccggacggaaaccatgaacaatttctgaaagccgtggctgagcatcggcattgggacagaaacgtataagaatgaaaaagcgcctttgatgagaggggcgcttttttcttgtgaaagaatattgggagaaaacgaaaattgcttccgtacaaatccgtatcttccgctgtcctggacattcagacaacagttttagagagtcagggcatgcgctatttaaagcaggcgggttgatgaaataatagtttcaccctctttggtttacttccgccctgtgtttgtgtatcttaggggtagattttctggaggagcgattgatagtgaagccgtttaccgaaaaacaacttgaagaatattaccggcgtgacgaaaacatgatgattttggtgtttgcccaatggtgcgtcaatcatgaccttgatccgatggccatttacagcaaagcttaccccggacagcctttaaacgaagagctgcgaaaaacggctgaagagcttgtcgtgccgaaggaggaatcagaaccgattcctgatcaaaccgtcatcggcgttttggagatgttcggcaactccgatttggcggaagccgtttatgaagccattgcgcaaagaccttcacggtaaaagaggcgtggattatccatgtctctttttttcatggagaaaatgtgaaagaaggcccagaaacaatttgctgatctgcgctgtctatagagtgtaatccgttttcaaaaagggaacggtaatgaaaaggaggagttgtgatgaaaaaggcattcaaaatgatggcggccgtgctcttaaccgtgctgacagccgcgccgttcggaggtttcgcgccttcagccgaggccgcgcaaactgcaaagcccgtcgtcaaaagccagacgtataagcatgtaaagcagctgacgtaccccgaggtcacaaatacgggaaacgcatcttttgaaaagaaaatcaatcaggacttcaaacgctatattgaaaactcgtaccaagaatatgtaaaaaacaaaaaagacggtgaaaaacaaggctacaaagcggaataccaggcagatttcaaggtgaagtataatcaaggcggcaagctcagcattcagacggaaaactacagttacacaggcggcgcacacgggctgacagccgttcagacctttaattacgacctggccgcaaaaaaacgggtcacactcaatgatgtgctcaatacaaaaacgaaagccaacaaaacgagagactatctttacggctacatcaagaaacatgacgatctgtttgaccaggacgtcaaaaaacaagagatcatcctgaataacgaaagacctttcttctttacgaaaaacggcattgccgttgtgtttggacaatatgatctcggaccatacgcggcaggaatccgggacgttttcgtgcctgcatccgtctatcaataaaaaaaagcgatatcactctaaaacggagcggtatcgctttttttattttaccagacaaacaatccgacaatcgccgcgctcaataaggaaacggcaattccgctgacaagcagcttccagacgttttttccgatgatggctgacttttcaccatcaagcagagattgataagatccgtagatcataccgatggtgctgaagtttgcgaatgatgtcaggaatgtcgtagccacggcaatcgtgtgcggcggaagtgatttcagctgccctttcagatcggccattgccacaaattcattcgtcgcgagcttgatgcccatcagctgtgcgacatacatcgcgtcatgtacgcctaatccgagaaggaaggcaaacggactgaagatgtatgagaaaatcttttgaatggtcaaaccgtgcatgaacagtccgagtacgccgtttaacgcagccgttaacgccacatatccgattaccatcgctaaaataacaatgaccatgttcatgccgacaagcatactgttagaaatcgtggagaagaagtcttttttctccgcttttgaaggaacgtaaataatatcatcctctttagaaacgtccacgggattcagcatattggcgattaaaagcgcgtttaagcaattcagcgggatagctgtaaacacataagtggacggaaccatcgtcaagtacgatccgatgatcgaaccgctgatgctgctcatgctcatcagcccgaatgtcagaagccgattgttgctgacggcggcaagctgctggcggatgacggctaaagcttccgtatttcctaaaaacatcatctggatggagaaaaagctctccagcttcggcagacgggatattttagaaatcagccagccgattttatcaatgagccacggcagaataccgaaatacgacagcatatcaaagaaggtcacgacgaagataatcggcagcaatgcgctgaagaaaaaatcaaccgtcggattggccatgatagacggaaaagcgaacgcaattccttgactggcgcaggaaatcagccatgtaaagaacgcgccgatcttcccgatgacaaagccgccgacttttgtccctaacataaaccaagtaatcagaaactcaaagacgaggagcatgacaatcggacgccatttaatcttcttcttgttgggagaacataagaaaacaacagccatgacaacaatgagaccgacaatgttcaataaaaagtacatgtgagcaactcctataagggtattatggaaataaaaaaagctcttattcgtcacaaattcctgaaagccagaaagtgtgataaataagagccaaaagaaaagaatagactgagagcatcatatgcttttcactcgttcaaatttatgcaaactttcttgtagtctagtcttttacggcactaggtagaaacaatcagaccatattactgatcatatacaagaataacgatattacatgagatagcagtattttatcgtttcaatttttgaaaatcaacctttttagatattttcaaaataataaatttatattataaataaagaaaataaaggatgttcacaagtaattggattaaaaaggtataaaaagcccccgaaaaacagttccggttcattgtaaagacgggatgcagctgataaaatggatctgagggcaccgccttcaaaagacggcagaaaaggggtcattttcatgatcattcagttcattcgttacagataatgagaggtatagataaataggttaaacttccaattttgcgaggtttatttgtctatgcctttttcatttcatcggaataacgaatgaatgaggtgtttttattgacgtctataaaaagaaaacgcgcggaattactgcaatcatgccagtccgtattcaggtgtccgctatgcagttcggccatggcggtctcacaatacaaaagcttgatgtgcggacacgggcatacatttgatatatcaaagcaaggatatgtgaatttcctcaataaatcggtcaaaacccgctatgacaggcagctgttcgaagcgagacgcgctctttttgacagccgggaattttttgggccggttcaaaaggagatcgccgccatcatcagccgcattcaatctccgcaaacaacggcggcgatattggatgcgggatgcggagaaggcactcatttagccgccgtatgcaaattgcttcagcccgctttttccgtgacgggaatcggcattgatctctcgaaagaaggtgtgctgcatgccgcaaaggccttcggggatcatttggtttttgccgtcgctgatgtggcggatgcgccgtttgccgacagctgttttgatgtcgtgatgtctgttttatcaccttggaattacaaggaatgcagcaggcttttacgaaagggcggcacagtcattaaagcggtgccgcggcgtgattatttgaaggaagtaagggaattcttcttcggagacagtcctcggcggaatgacaccgccgattctgcggccggacgattccaagcgggctttcaaacctttgagcgcaaacggctgtgttacacgaagaccttatcgcagcctgaccttgagcggcttgtgaaaatgacgcccttaacatggaaatgtactgatgaaagcatccggcggtttatcagccgaaaagcggcggatattacgatagatatcgatattttaatcggaaccggtcctctgtaaacagaaaagacacgctgatcgcgtgtcttttttttatttccagacttcaccggcaatgttgacgacatgacgcagtttcgcccattgctgttcttctgtgatcaggtttccttcctcagtggaggcgaatccgcattgcgggctgaggcaaagctgatccaggctgacatattgtgaagcttcttcaatccggcgtttaatcgcgtccttgtcttcaagttcgccatgttttgatgtaatcaatccaagcacaagctgaagatcagagcgtttgacatagcggagcggttcaaagccgccggagcgggaatcatcatattccaggaacaatccgtcaaggtcaagcccgtcaaaaatcgtttcagccgctgcatcatagccgccttcagccgtccatgtggattggaagttgccgcggcagatatgcatcgtaaccttcagatcgtcagggcggtccttgatcgcgtcattaatggaagcggcaaacagcttgcgcagctcatccggcgttgtgccgaaatcttcaatctgacgaagccccgcttcagataagaaaacggcccatgcggtgtcatcaagctgaaggtagcggcacccggcgtcatagaaagcctgaatcgcttttttatacgcttttgacacatcgtgctgaaattgtttgtaatcattctggtaggccgctttttccaattttccgcggaaaaacagcatattcggacttgggatggtcattttcggaacagcatcgccggcaatgctgtgcaggaatttataatcttcgagcatcggatgctgagaaaaatcaatatctcccgttactttaatgccgcgcgctttcgtctgtacgttgtgaaactgaatgccgctttcaggcgtaaatgcctcaaccccgtctaaattttcgagaaaatcaaaatgccaccaggcacggcggaattcgccgtcagtcacgacattgaggccggtttctttctgcttttccacgctgcggatgatttctctgttttcgatttcgcgcagctgttctgccgaaatctcacccgccgctctttgcaggcgggcttgcttcacagccgccggccgcagcagacttccgacctgatccgcgcgaaacggcgggttttttcttagaagagtatgcaatggttgttctgtgttttgctgtgacatgaacgattccttctttcctgatgaaatgaaatataaaaaaactcttccctcggatagggaagagcttgcgtccgcaaatctcaaccttatcttcaggatttagcaccattctgctgaacagcggttgccgggtatcatagggccagtccctccacctctcttgataaggaaatatgctatttttcagaataaactgtaatactcttaatcttagtatgttttctcatattgtcaatatatttcgataaatatttttatttgtcaccctcaaatagaatcatatctatcacgatggcgatcgcaagacaaagagcaatatcctcttccttttcaatctgcaaatgataggaatcgccccagctcatccatgatttggtgacggtcatccggtttgattttccgtctgtcacttgaaaattccggccccacacatcgccggtaagattccagccgagtccggaaatttcaaatttcggtttgaaaaacgtgactttcttgatgacttggcagacgggtttgccgctgacggaaatctcgtaacggggaacgagcgacatcagtttctgattgacgctggcgagcgtgcggccgtccaaatcagtcagcttcagttcatcaccgaatgaaaacagctttccttcaacattgtagacttcttttccgctttcaagaaacacttgaaaacgattcttaaacgtaaacattcgctctttgatgtaaaaatggtacataaaaaaactccttttttatgttttacgaaaaaaggaggcggaaggtttcatatcggccgggtgcataaaaaaaggctgccgattttgcggcagctgtcgtttttatgatagcggcatccggcgtttttgacggatcgcatttaaatcaatgatgttattcgtgtcggcagctgtcaccagcgggcttgtctttggcgttttccggcggttgtccttactgaaagagaaaacaagataccctgtcaaagcagcgaaaataagtagcatcattttacatacctcccaaaaaaagttttggtattattattgtacgaaaaaacaaacgaaaagtattcaaacaattgtcacttttttaaaaaataacgtcattttccgtaaaaataactatgggttgaagaaattttgctcttgttgtggttctatagattgtatcggctgatgaatgatgatcgtttatataactttattactattttttgtaagtgtctaattaactacttcggtgttttcgtttgccttgtgttattcagtaccctaaaaaaccttatgatatgcaaaataactgcttctaacagatgactgcgagttgacagcgctttctttatttttttaaagaaaacgagatgttatcttaaaaaaatcgtttgaacattttccgcagttttttaaaagggtttgattttgtctccagtacacgcgggtcttttaaggtttttttcaattctttcgctacagtccctcttgccatagtcttcactccttctttccatttcataccttatatacggaaagaaagaaggaaaggtttcatgtgaaagaaaaaaaccaaagcagggggctttggttttaagcgcgctcttcaaagagcctggcgatttcaacaatgacgtttaccgccttttccatatgatcgacggaaatgtattcatattttccgtggaagttttggccgcccgtgaaaatgttcggtgtcggcagtcccatgtaagagagctgtgagccgtcggttccgccccggatcggttcgataatcggttcgatgtcgaggtttttcatggcttgatacgcgacatcgactatctctttgaccggttcgattttttctctcatgttgtaatattgatcacgcagttcaagcttgatgctttccttgccgtatttggccgccagcgcatcggcggttttctgcatatattcttttcgttctgcgaagcggtctctgtcaaaatctctgatgatgtacgacagggcggcttcagaaacgtctccgtccatggaaagtaaatgatagaagccttcatacccttccgtatattccggcgcttcttctttcggcagcgcgtgatgaaattccatcgcgatttttgaagcgttgaccattttgtttttcgccgttcccgggtggacgctttttccgtaacaagtaagctttgcggcggctgcgttaaagctttcatattgcagttcgccgagggggcctccgtctatcgtgtaggcgaacgcggcgttgaagcggccgacatcgaatttgtgagggcctctgccgatttcttcatcaggcgtgaacgcgacccggatcgttccgtgcttgatgtccggatgtttgatcaagtacgccattgccgtcatgatttcggcaatgcccgctttgttgtcggctccgagcagcgtcgtgccgtctgttgtaatcagcgtctggcctttatagcgggaaagttccgggaattgctcaggcgacaggacgacattgagtttgtcattcagaacgatatcatgcccgtcgtagctttcaataatctgaggattcacattttttccggtaaaatcggtcgcggtatccacgtgagccagaaaaccgacagtcggcacgtctttatccgtattcgccggcagagtcgccatgacgtacccgttgtcatcgactgtaatttctgtcatgccgatcgactttaattcatctgccagcatgttggccaatgtcagctggccgggggttgaagggcagttttcattgttttcgtcagactgtgtatcgacttttacgtaagaggtaaagcgttcaatgatttcatttttcataccgtcatctcctttgtcttatcttaccatgcgcgggggagggatttctatttcacaacccgtttgaatcgagggctctgttttttacgcgaatgaaaataaattatgaagaaacgatgactaaacgattaaactttttggaaatggatgattgaggaagaaaaaaccgatataatatggtcaattcattcaataggggaggctttcttcatggcgattttagtgacaggcggagcgggttatatcggaagccacacatgtgtcgagctgttaaacggcggctatgacatcgtggttctggataatctgtcaaacagttcaccggaagcattggagcgtgtgaaagacattaccggaaaagggcttgtgttttatgaagcggatctccttgaccgtgccgccgttcaccgggtgtttgctgaaaatgagattgaagccgtcattcattttgcgggattaaaagccgtcggtgagtctgtggctgttccgctccgttattatcataataatctgacgggaacgtttattttatgtgaagccatgcaggcacacggtgtgaaaaaaatcgtcttcagttcttcagcgacggtttacggcgttccggaaacaacgccgatcactgaggattttcctttaagcgccaccaatccttacgggcagacaaagctgatgctggaacagattttacgcgatctgcataatgcggactctgaatggagcattgcgctgctccgctactttaatccgttcggcgcgcacccgagcggccggatcggagaagacccgaacggcatcccgaataatttaatgccgtacgtcgcacaagtcgctgtgggcaagcttgagcgattgcaggtgttcggcaatgattatccgacaaaggacggcaccggcgtgcgggattacatccatgtcgttgaccttgccgagggccatgtcaaagcgctcgaaaaggtgctgaacacaacgggcgccgacgcctataatctcggcacaggaagaggctacagcgttctggagatggtcaaggcgtttgaaaaagtatcaggaaaagaagtgccgtaccgttttgccgaccggcgcccgggagacatcgccgcatgcttcgcagacccggcaaaagcgaaggctgaattaggctgggaagcaaagcgcgggcttgaagaaatgtgcgccgactcttggaagtggcagtcctccaatgtgaacgggtaccaaaaggtgtaaaaagaaagagaccttcaaatgatgagggtctcttttgttatgatgattatttaattttcacttcaacatcgttgctgaactttaatttccaagtgcctttagagtatgcgtttttatccacttcaaaagcttttacgtcagtcactttaatgttcgggttcaagtcacttaaaattttactgttgtctacttttgtttctgttgcatagcttgaagaagcatcaatatctgaatcataagatgttcctttagaatctactaatttcgctcttggaatggagaaagagcttaacggcttgtttgaaacatttttaaccgtgtattgaacagctacgataacgccgccgtcagacgcttttttctcgacaaattgagagcctactgaatctcttttttccactttcgtaacagtaacttcagttttctcagtcttaacagtgtcaccgatgttatacagtttttctttagattccgcagcttttgaagacgcagttttagatgacgaagaaccgcctccgccgccgatgtttacgagaatgataataaccaccactgccagaagcaatgtgatgattttatgtctcatgaaaaagtttctctgatctttaccgcagtttgggcattttttaacgcctttagcgatttctttgccgcatgccttacaagacaccaggttgcctgccataatatttcctcctatgtaaactatttcttaaaaactacatactataatgcctgtaaaataacctatagtcaataatattttgagaaaaaaagtattttaatgattttttagtcatgtattttaaggtcctttttagtatcggcagatcgttcgcattttccataggtttaatgaaaaaagagtggttgaacatgttcgtgatttcccgtataatcttgaaagataatataaaaactgaacataaaaaacagtggttttctagggttccgcaatgctgaattggtctggaccgagagaaaacacacagcaggttcctgctgtgacacgttgggataaaagcccgggagtttctgctcttttaatgaagagtgctctcccgggcttttttgattttataaaaaagggagtgtctgggatgaaaaagagattgctggatgtgctgatgctgattattggagcttttatctttgctttggccgttaatttattcgccattccgaatgatcttggagagggcggggtaacgggaatcaccctgatcttgtactatgtgtttgaatggtcgcccggggtgacgaatatcattttgaacgggattttattgattatcggatataaatttttagacggaaaaacaacgctttatacgatcattaccgttgtcgccaactcactgtttctgcatctgacgcatgattggcactcgccttcacatgaactcattattaatactatttttgcgggtgtgtttgccggtgtcggaatcgggatcattattcgagtcggtggcacgactgcgggttctgccattttggcgaggattgcgaacaaatatctcgattggaatatcagctatgcgcttttgttctttgatctgattgtcgtcttcagttcttatttcatcatcggtgcggaaaaaatgatgtttaccattgttatgctgtacatcggaacgaaggtgatggactttatcattgaaggcctgaatacgaaaaaagcggtgacaattatatctgagcataagcacgaaatcgctgaacaggtcaacacgctgatggacagaggggttacgctgctgtcgggtaaaggaaattacacggggcagtcgaaggaaattttatatatcgtcatccagaaacaagagctttccatgctcaaaaaaattattaaaagctgtgatacaaaagcgtttgtcattgttcatgatgtgcgtgatgtctttggtgaaggcttcgtcgatatctctaaataaaaaggatccctctgccggcgcggagggtttttttcttatgccggcagaagcggttatatccgtttcccgggaaatagcctgaaagctgtttcttaaaacgaagtggatacaatcggccggacgttttatactgaaaatatgatagagcgatagaaaggagcgcatatgaacccgttattggcaatttacccgagggctgtgttgtctgatacgtgctgtacggcggaggatgtcttttgcttttatgatgagaaaaggcgggtctatgtcgccattccgaaggaggatatcaccccgaaggagaaactgcttctggaatcatttttgacgcccgctgaagaaaaaggcgttttttttccggagacggcggcagcaaagaggtggcggcgttttctgctggaagaaggtccggtgcctgatgtcaaggagccgcgtgtccgttttatccattatgacttattgggagaacgggactggggggcattcacagaagcgctgcgccatttctggccggtttcatatacagttgtccggacggggagggatcatggcgtgattgtggaggaagaaaagctggaagcgccagattcggatgacatcgcatcttttgtgaagattctcgaaggcgatttttatttcagtgtccgttttttcgtcggaaggtattactgcaagggggaacgtctgcgccttcattatcagagagaacagcaatattgtcagatcggccggcgtcatctcccgcagctgagcacgctgaccgcggaaacggtatttccggccatgctcacggaggaaagcagagaaaagctctcagccttgcttcacgaagaagcggcgctgctgtttcagaaagaaccggagctgaagcatacgattcagacttttattgaacataactcaaacatgtcgctcacatcgaaaaaactgcatttgcaccgcaacagtcttcaatatcggattgataaatttgcggaacgctcaggtattgatattaagacatatcggggcgccctgctggcttatttcatttgtctgcaatatgaaaaatcacattaaatgggaaatgtgcacgaagacagcggtctttttttatgaacattgcctatatccgccgccgtctgacgctgttacaatcctatttaagaaagcgtttacaaataaagggggatatacatggcggaacttcggctcgagcatatttataagtattacgatcaaaaagaagcggctgtcgatgattttaaccttcatattaaagataaagagtttatcgtgtttgtcggtccgtcaggttgcggcaagtcgacaactttgcggatggtagccgggctggaagacattacgaagggcgatttctatatcggtgacacgagagtgaatgacatcgctcctaaagacagggatatcgccatggtgtttcaaaactatgcgttatatccgcacatgacggtctatgataatatcgcattcggtctgaagctgaggaagatgccgaaaccggagattaaaaaacgtgtcgaagaagcggcgaaaatgctggggctcacagagtatctgcaccgcaaaccgaaggcgctctccggcggacagcgtcagcgggttgcattagggcgggcgattgtcagggacgccaaagtgttcttaatggatgagccgctgtcaaatctggacgcaaagcttcgggtgcagatgcgggcagaaattattaagctccaccaaaggctgcaaacaaccacaatctatgtgacgcacgaccaaacagaagcactgacgatggcgacacgcatcgtagtcatgaaggacggaaaaattcagcagatcggcaccccgaaagaagtgtatgaacatcccgaaaacgtatttgtcggcgggttcatcggttctccggcgatgaactttttcaaaggaaagctgacggacggcgccattcagatcggttcagccgctctcagcgtgccggaagggaaaatgaaaatgctccgggaaaaagggtatgccggcaaagatatcatcttcggcatccgcccggaagacatacatgacgagctgattgtggtagaatcttataagaattcatccatcacagctaaaatcaatgtcgcggaattgcttgggtcagaaattatggtttattcccggatcggggatcaggattttatcgcccggattgacgcccgccatgacattcgtgccggtgaggaattgaccgtcgctttcgacatgaataaggctcacttttttgacagtgaaacagaaatcagaatccgctcataacgcaaagccggacagctggatgtccggtttttttgatgtaacaatttatgacgcataaccgatataaaaagtaaatagaagacagaaagcaggaaaacgatgaaacgcatgatcatgtgcatgtgccttttggctgccgtgtttacacttgccgcctgctcgggtcatgaggcaagcgccgaacaaagcattccgaaggcagaagcgcacagcgaaaaaaagtccgtaaagcggcaaatcaaaaaagagccggatacgtccgcctgggttcaaacgaaagggatggcgagactgccgattctgatgtatcacagcatttcagagggaaacagcctgcgtgtgccgaaggaagaattccggcagcatatgaagtggcttcatgatcacggctattatacgatgactcctgaagaggcctatctgatgctgacggaggataaggagccgcgtgaaaaatgtgttctggtcacatttgatgacggctatacagacaatgtgaaagcggcctatcccattttaaagaaatacaagatgaaagcgacaatctttatgatcggaaactttatcgggcataagaatcatctgactgagaagcagatgaaggagatggccgcccacggcatttccattcagagccatacgatgaaccatctcgaattgaacgggctcacaccgcagcagcagcgacgtgaaatgaaggactctaagcgtttatttgatcaaatgttcgggcagcggacgtctatgatcagctaccctgtcggacgatataataaagaaacattaaaagccgccgcctcgtcaggctaccgtatggcggtcacgacggagccgggagcggcgtctagagatcaggggctttacgggcttcaccgcgtccgtgtgtcgccgggcatgtccggcgcggcattcggctcttatattcaaaatgtgatgaaataacagagcctccgcatatgcggaggctttttttcagtttaatagaattgatgaagcagcagaagggtgacgctcacggtaatcgctccgccgattctggtcgacacttgggcgaacggcataagctcaagccgttcagcggcgctcaagatcgcgacgtcgccggtgccgccctggccggaatggcaggcattaataaccgccgtttcaatcgggtacagattcagccattttccggtcagaaaaccgacggccatcatcgtgacgacgattgataaaatggtaatgatgttgctgattgtaaacgccgcaatcagcttgtcccacggtgtcattgaaacgccgatcgcaaataagagcggataggtcacggctgtcgagaaaaagcgcgagacgccgaaggctccgttttcaatcgaagccggcgccagcctgaacagcttaatgagaacggcaaggacgagcatcacgactggagccggaagctgaaagaaatcatgcgccagcatgccgaccaaataaagggaaaccgctaaaataccgcccgaagcgaaaaaggacaaatcaaacgttttatcatcggccggctgttccaatgcgggagcggaatgatcagacttatcaaccttcccgttgcccgtccattccggtttgcgtttcccgatgacattcagcaaacccgataacataatggcgcacaggctgccgagcatgatggacggcagcacaagcgcaaaggcgtctccctgggacatcggcataatatcggagtagccgatggataaaggaatcgcgccttcaccgacaccccccgccataatcggaacgacgatataaagcagcgtgtgctgaaagccgagcccgagcagcgtcccgacgcataagccgacgatggcggccgcgatagacccggcgatcagcggaataaaaatcttaacgaaagctttgacgagcgtctctcttttcatcccgagaatactgccgacgacgataccggcaataaatagatagagaaagttggagctttccgtgaattctgttgttgaagtaataatgtctttcggaagcaggtggtagtagacgacagcggatggaataaaggttgcgagaatcgcagggccgccgatggaccgcacgatcggaatggattttccgatctggccgaaggtaaatccgaaaaaactcatgacggcaattgatgtcagaatgtcgctttttacatcacggctcatgacaaacaccgtaataagcaagaaaagcaggatatagataggaagaggaataatgccgattcttatattcattgctctggcaaaccagttatcagtccgttcctgtttttggattgaatccgtttgcaattttggttgaagttctcccatgcttgttcccccagtcgttatgtagtgaaaaaatatccccatttaaagtatactaaaaaatttaaattgttcatatattatgaatttactagaggacatgctttcttcacattttctttctcaaaatggcgatttggcgggctttttcaccgagaaaagcattttgttcgccacacgaataaaaaagaggtacgatatcaaagggacaaatatcctaggtgctgacataaaatctctacaaatccgacaataatcagtcacaatttcagcctgattttaggtatattgatctttttttttgggctgaatcgttgtaaagtaatgatattgaatcatttctatgacagccgctgtcccccagggtgtacaggctgatatttcaatagttttgacgaatttgtgaaacattgagcaaatatatcattttttgtgaaataccgagcaatgatttcactatgtttgtgaaatgttgagcaatttaccagattggaggaaaaacatcatgagtgagttggtattagcccgcattcaatttgcatctacaacattgtttcacttcttgtttgtgcctatgtctatcgggcttgtgtttatggttgctttgatggagacgctttatgttgtcaaaaaacaagagacctatctcaaaatggctaaattttgggggcatctctttttaattaactttgctgtcggcgtcgtcacagggattcttcaggaattccagttcggattgaactggtctgattattcccgttttgtcggggacgtatttggggctccgcttgcgattgaagcgcttttggcgttttttatggagtctatttttatcggattatggattttcggctgggaccgtttatctaaaaaagtgcatttgctttgcatttggcttgtatccttcggaacgattatgtcatctttctggattttgacggcaaactcattcatgcaggagccggtcggctttacgattaaaaacggccgcgcggaaatgaatgacttcggagcgcttttgacaaaccctcagctttgggttgaattccctcacgtcattttcggagcgcttgcgacgggtgctttctttatcgccggtgtcagcgcatttaaattattgaagaaaaaagaagtgcctttcttccataaatctttcaagctttcgatgattgtcggtctgatcgccggtatcggcgttgcgttcagcggacacatgcaggctgagcatttaatggaatcgcagccgatgaaaatggccgccagtgaagcgctttgggatgacagcggtgatcctgccgcgtggacggcttttgcgaatattgatacgaataaagaaaaaaacacatcagaaatttcaattccttacgcactgagctacttggcttaccagaagttcagcggcagtgtgaaagggatgaaaacacttcaaaaagaatatgaaaaaacgtacggaaaaggcgactatatcccgcctgttaaaacgacgttctggagtttccgcattatggcgggagcgggtgcgcttatgatttttgccgcgattgcaggctttattctgaaccgccgcaaaaagcttcatacgagcaagtggtatttacggggcatgatcgcactgatcgcattcccgttcattgcgaactctgccggatggattatgactgaaatcggccgccagccgtggacggttatggggcaaatgacaaccgcacaatccgtttcgcctaacgtaacgacgggatctctgctgttttcaattatcggtttcggcgtcatgtacttgattttaggcgcgctgcttgtcttcctattcgttcgtgaaattaaaaaaggtgcggaccatgatgatcacaaggatgttcctgtatcaacggatccgttcagtcaggaggtctaccatggggtcacttcatgatctttggtttgtactcgtttcagttttgtttgtcggatttttctttttagaaggttttgatttcggtgtcggcatttcgacccgatttcttggccataatgaattagaacgcagagtgctgattaacaccatcggcccgttctgggatgcgaatgaggtatggctgctgacaggtacgggagcgatcttcgcggcattcccgaactggtatgcgacgatgctgagcggatattatattccgtttatcatcatccttcttgctttaatgggccgcggggtggcgtttgaattccgcggaaaagtgaatcatttaaaatgggtcaaaacatgggactgggtgattttcttcggcagccttatcccgccgtttgtattcggccttatcttcacaagcttgttccgcggcatgccgattgacggccatatgaatatgcatgcgggtttctcagatattgtgaacgtgtattccgtccttggcggagcagccgtcacccttctttcattcctgcacggtttaatgtttgtcacactgcgcacgatcggtgatttacaagagcgtgcgagaaaaatggcaaaacgcgtaatcggtgttatctttcttgttgtacttgctttctttgcgatgtctgcatacgatacggatatgtttacacgccgggcaaacatcacgattccggtattcgtgctgattgtcatctgcaacgttcttgctgttgtgttcatgagcaagaaaaaagacggctgggcattcggtatgaccggcgcgggtcttgctttgacagttgcgatgatttttatctctctgttccctcgcgtcatggtcagctcgctgaaaagcgcgtatgacttaacagtagctaacgcgtcttccggtgattattcacttaaggtcatgacaattgttgcactgactctgctgccgtttgtcatcggcagtcagatctggagctattatgtcttccggaaacgcgtcagccataaggagcctatgacttattaatgggaaaagacctgtttctttataaaggaatgaagcggattcttgcgatcattacgggattaacgattatacaaacggccgccatcatcttgcaggcggaatggctgagccaggcggtaaccggattatttaacgggaagcggattgcttctctttatccggttatcggctttttcctgcttgcgtttttggtccggcatgcggtaaccgcggtccggcagaaaatcgtgtaccaatatgccgcgcaaaccggcgcagacttaagaaaaagatttcttgagcaattgttccgtctcggcccccgctttgcgaaaaaagaggggacgggccggatggtgacgctggcgatggaaggcatcagccagttccgccgttatttagagctgtttctgccgaaaatggtcagcatggcgattgtgccggcggccgttgttatttacgtgttttttcaggataaaacatcggctttgattctgattcttgcgcttccgattttgattgtatttatgatcctgctcggacttgtcgcacagaaaaaagccgatcgccaatggaagtcctatcagacgctttccaatcatttcgtggattcgctccgcggactggagacattgcggtttttagggttaagcaaatcacacagtaaaaacatctttcatgtcagtgagagataccgcaaggcgacgatgagcacgctccgggtcgcgtttttatcatcattcgccctggatttctttacgatgctgtcggtggcgacagtggctgtgtttctcggcctgcggctgatagacggacaaattctgctcggtccggcattgacagcgctgattctcgcgcctgaatattttctcccggtccgcgaagtgggaaatgattaccacgcgacgttaaacgggcaggaggcggggaaaaccattcaagcgattttggcgcagcccggttttaaagaagaaaagccgctcgaacttgatacgtggactgacggggatgaattacagcttacgcgtttgtccgtccgagaatcgatgtctgaatttcatctgtcctttaaagggaagaagaaaatcggaattatcggggaaagcggtgcgggaaaatcgacactcattgatgtgctgggcggctttttagagcctgcgtccggtgagatcaaggtaaacggtgaatcccgctcgcatctgcagtcagacggctggcagaagcagctgctttatatcccgcagcatccgtacatttttgatgacacgcttatgaataatatccggttttatcatcctgatgcttcccgtgaggaaacggcgcgcgctgctgattcagcgggtctttccggactgatccgcgatctgcccggcggccttgacggccggatcggcgagggcggacgggcgctcagcggagggcaggctcagcgtgtcgcgctggccagagcctttttaggaaaccggccgattctccttttggatgagccgaccgctcaccttgatattgaaacagaatatgaaataaaagaaacgatgaaagacctgtttgaaaacaaacttgtctttctggccactcaccgtcttcactggatgcttgagatggacgaaattatcgtgcttgatgacggcgcggtggcggaaatcggcacccacgacgaattgatggcgaaacaaggcgtatatgccaaacttgtaaaggcgcaactgggggaaagaacatgagaaaagaagaatggattctgccgtatataaagcaaaatgcccgtttgtttgttcttgtgatttttttaggcgcggtgacgattttttcggcggcctttctcatgttcacttccggttttttgatctctaagtcggcgacaaggcctgagaatatcctgctggtgtacgttccgattgtggccgtgcgcaccttcgggattgcccgttcagtctcacggtacgccgagcgcctgacggggcaccatatcattttgaaaatcgtgtccgatatgagggtgcggctttacaatatgctggagccggcctcgctcatgctttcatcccgttttcggacgggcgacatgctcggcattttggctgaggatattgagcatttgcaggatgcgtttttaaaaacgattttcccggcggtttccgctttgctgctgtatgcggcatccgttatcggactcggctttttttcctggccgtttgccgcttttgcggcgatttacctgtttatattggttgtattgtttccggttgtgtcgcttcttgtgacgagagcgaaaaacatgaggctgaaaagcggccggaatacgctctacagccggctgacagatgccgtgctcggcgtgagcgactggatgttctcgggacgacaggcggcctttatttcctcttatgaagagaaagagaaggcatggtttgaccttgaaagcaaacgtcagcggtttacgagatggcgtgatctcgccgcgcaatgccttgtcggcggcttcatattgatcatgctgttctggacggcgggtcagtatgcggacggcagcatcgccaacacgatgatcgcagcctttgtgcttgtcgtatttccattgacggaggcgtttctgcccctttcggatgcgctgacggaagtgccttcttatcaggattccatcaaaagaatgagtaaggcggctccggagctgcgaagtcgtgaggtgaagcagacagatgagatactggatgtatccgatgtgacacttacatttgataacgtgacgttttcttatgatcagcacagtcatgtgcttgaccgtttttccttcactctccgccagggggaaaaaatggcgctgctcggcaggagcggctccggtaagtcgacctctctcgctttaattgaaggcgccttagttcccgattcgggcaaggtgatgctgaacgggctggaaactgcggccgtgcaggagcagatttcctcagcggtggccgttttgaatcagaaacctcatctctttaacacgagcattatgaacaatatccggctcggaaacggcaaggcgagtgatgaagatgttaagcgtgcggctcggcaagtgaagctgcatgattatattgaatcactgcctgacggatatgaaacgtccgtgcaggagacggggattcgtttctcaggcggggaacggcagcggatcgcgcttgcccgtattctgctccaagacacgccggtcattatccttgatgaaccgacgatcggccttgatgcggtcactgaacgagaattgcttgatacgatttttgatgtctttaaagagaaaacgatcctctggattacacaccatttagcgggtgtggaaacagctgataaaatcgtctttttagaaaatggaaaagcagaaatggaaggaacccatcaagagctgcttgcagaaaacgaacggtaccggaagctttaccgtcttgatgttccgatcagaacataaacagccgcaaacgagcggctgtttttttgtgcggtttaaaatctcttcttgtttggaatataaataggagacagaagaggaggtacagagatgaatataatggattggacggaacaggatgtgaaagatacgctgccgaaacgggaggcggacagccataaaggcacgttcgggacggcgttattgctggccgggagcgatgacatgccgggagccgcccttctagccggattgggtgcgatgagaagcggtgtcggcaagctcgtcatcggtacatcggcaggcgtcattccgcttatcgtcccggtgctgccggaagccacgtactggcgggacgggtggataaaagccgcggcgggccagcccggggaaaccatccgggccgctgccatcgggccgggccttccccaaacagacgaggtgcagcaggcggctgatcagctgctttctggcgattatcccgtcatactggatgcgggcgccattacgaaaagaacctatccgaagaggaaagctcccgtgatcttgacgcctcatcccggcgaattttccagaatgacaggccttccgattcaagagattcagcagaacagagcggaatatgccgcggaatgggcggagcggcttcatgtcacgattgtcctgaaaggaaacgaaaccattatcgcttttcccgacggggaatgccgcaggaatacaaccggaaacggcgcgcttgcaaaaggcgggaccggcgacacgctgtcgggaatgattctcggcatgctgtgctgtcatcaagacccgaagcacgccgtattgaacgccgtccgccttcacggcgaatgtgcggaattatggacgaaagagcgctccgcccataccttattggcgcacgaactttctgaactgctgccgggtgtatggaaggaatatgaataaagaaaaggcgtcttcatagggaaggcgcctctttttgttttaaccttgatttcatcaggacataatacagcagcgacggaacggccaggccgatgacccaggcaatgtcgcctccgccgaatatttcagcgagcggcccgatgtaaaaggatgtattgatgaacgggatttctaatataatcgacaaaacgaaggcggccgctgtaatccaattgaccctgccgtattgtccgttgacgtcaaacatcgatttgacgtggtattttccgcggcggataaaatagtaatccacgaggttgatcgccgtccatggaattaagaaataactgatgaaaaagatgaaatttaaaaacagttccatgaaattgctttggcccaagagacttaatacagtacccgctgccgtcacacaaaggatcattaccactctcgttttcggcgtcaccttcagttttaaaaacggctccaaggtagtcgtggttgacataaaggctccgtataaattaaagacgttgatcgccatttgcccgaacaggacgatgatcagcataataaaggaaaacggaccgaacaatcggacaatctcatttcccgcattagcggtaaattccgggagcgccgtcgtcaaaatggcgccgagaagcatcatccagatggaactgactgacgtacctgcatagctgtaccaaaaagtatgcgatgccggtgttttgaccggcagataacgggaataatctgcgacatatggcgcgtatgccagctgccatgtggccaccgcgctgaccgccactagaaaaacaggcagatctaatgagccgggcacccagcttcctgaaggaatcggcagttgaaaaataagaatcgttgcagcaaaaaaaacggcaaaggaggtccaagagaggattttctgcattttgtgaatcagatcatgaccgtagatcgtgagtaaaaaacagatggcgcttaagccgataatacaccatgaagccggaatcgggacaaagctgctcagtgtaccggctgcgagaatcgtactgctcgcaaagaagcccaggtagataaacatgaccaaaaagaggggcagaatcgctccgatcacgccgaattgcgcgcggctttgaatcatttgcggaattccgagctgaggtccttgtgcggaatgagacgccataaagattgcgccgataaaggttccgatcacaatggcggcgatactccaaaagagatcgagtcccattgtaacgggcagtgtgcctgtgactaacgtcgtaatatgcatattagccccgaaccagacggggaataaatctttagcctttccgtgtctttcgtcatgcggaatatgttcaatcgttcgcctttctactttcaatagataatctcctccgtatgttcttctttaacataaagacatagcttaacagattgacctgccgtttacaaattccagcatgcaggaaaaacattgtaaagcctcgctgacagccgttcaaagttttttgaaaaacggaacaaacactgccgcctaaacgatttaccagggattaaaaggtatggatatgcttactgactaatatgtatgaaggagaaatgtgtcaatcttttgacgaatggagccattattcgttaagctgaaagaatagtttactttgtgtaaatttcattaatgaaaaggggattgatgatatgtgtacaagtcttacattgaaaacgacagacggcaatcacctattggcgcgaacgatggattttgcatttcagctcggtacggacgtcgtgctttaccctcgtcagtacagctggaaaagcgaagctgacggcaggatgcataagacgaaatacgcatttatcggcatggggagaaatctcggcaatgttctgtttgccgacggcgtaaatgaaaaagggctgtcgtgtgcgacgctgtattttccgggctttgcgggatacgagaaagcggaacgggagggcacctgtcacatcgctcctcatgagtttgtcacctgggccttatcaaactgtgaatctcttgaagacataaaggaaaagctctcaatgctgacgattgtagagaagaagttaatgttattggatacggtgctgcctcttcattggattttatcagaccgcacgggcggctgcattgtcatcgagccgacaccggagggaatgaaagtatatgacaacaaacccggagtgatgaccaacagtccggaatttccttggcatgtgaccaatctgcgccattatatcggaatcaggccgcagcagtcagaaagcaaaacattgggcggaatgacattaaccgctttcggccaaggatctggaacgatcgggcttcccggtgattacacgccgccatcccggttcatcagagccgcttatctgaaagagcatttagagcctgccgctcatgaaacggatggcgttacggccgcttttcacgtgctgtccaatgtgaatattccaaaaggcgcggtgatcacagaggagaatgaaattgattatacgcaatatacgtcggtcatgtgctgtgacaccgggaactactactttcatctgtacgacaaccggcagattcacaaagtaagtttattccatgaagatcttgaccgtccggagccgaaagtatttgcggccgcggcggagcagaatatacaggagctgaattagctcaaaaaaaaaacaggacgcgattgtcctgtttttttatttaatacggatcagacggatggctttcctgttcagcctgttttgcggcttgtgctgtatcagtagtgccgatcggcccgccgctgctgctttcggaggcttttttcagcccttccgcaacacgttttccgtagtccggatctgcttttgtgaaattctcaatcatttgatcctgaatgtctttccggcaggaagaaagcgtattgaccaggtttgtgatcaattcggtccgttcaaattccgaaaatctgcggtatgtttcaccggcctggccgaagttattcggccggtcgatcgcttcccgcttcacatcgccttcgacatgaggtgtatggtctttcccatcctgctttgcttcggtgagtcctcccataatggacggctcatagttgacgtgcgggttttgtccttctgcccgatcgacccgatactgcatttgcccgccttcctggttggtggcgacatgctttttcggcgagttgatcgggagctgcaggtaatttgcgccgacgcggtaccgctgggtatctgaataggcgaatgtccgtccctgaagtaatttgtcatctgaaaaatcaaggccgtccacaagcacgcccgttccgaatgatgcttgttccacctcggcatggtagttttccgggtttttgttcagaaccaatttgccgatcggcttccaagggaaatcgtctttataccacagcttggtcggatcaagcggatcaaaatccagctcgggatgctcgtcatcagtcatgatttgcgcatacacttcccattcagggtaatcgcctttttcaatcgcctcatacaaatcctgtgtcgcatggttaaagtttttcccctgaatctcttccgcttccttctgtgtcaggttgcgtatgccctgtttcggttcaaagtgatatttgacgagcacggcttttccttcttcattgacccatttgtaggcatggacgcctgagccctgcatctgccggtagttggccgggatgccccacggcgaaaacaagaaagtgatcatatgagtcgcttccggtgattgggaaatgaagtcgaaaatacgctcgccgtcctgaatgttcgtaacgggatcaggctgaaatgcgtgcacaagatccgggaacttcagcggatcacggataaaaaagattttcaggttgttgccgaccagatcccagttgccgtcttcggtataaagcttaacggcaaaaccccggggatcacgcaatgtttccggggaatgcttcccgtggttgacggtagagaaccgcacaaacgccggagttttcgttcctttcttttgaaacactttcgctcttgtatatttagaaatctcctcgtctccaaaacttccgtacgcctcaaagtatccgtgtgcgccggcgccgcgcgcgtgaacgacgcgctcgggaatccgttcgcggtcaaagtggctgattttctccaaaaaatcataattctccaatgtcgtcggtcctctattgccgactgtcctgacattctggttgtcagtgaccggatggccctgccggtttgtcagcgtgtcttctgactcgcctttaccggtcgtcttactggaaagcgtttcttcgctgtttttgttattttccattgttgaaccctcctttttgaacggtaacaatatgcccagcagagccgttttttaaaaccgattttcaaaagaagcggttattccgcgatcggcgtcaaggacccgccgttccatatttcgcccttgttcagcgtccagctgttttgataaaggctttgcgcgccttgattggccgccggacttaattgttcatcccatgtcaaaaagtacgcggtctgagggtatttttgcctgatcgcattaataaaagcagcataatcaaagcttccgatattgccggacggaccggtttcggcaaaggcaaacggttttttcagagacagcatttcatcatagcctgatatcgcatacggatcagtgaagtaagcgtccagaccggtaatatccacataagatgagcctgggtagaagtctgttttaaagtctctgttggcatccggcgaatacacccacaaaaggttatccaatcctcttgtctctgtcatatagcggtatatcttcttgtaaagctctttgtacagcgagattctctcattgtctttttggttgtagcctgtcagcccccaccagaaccactcgccgttcatttcatgcagcggtctgaacagaacggtgacgccttgatttttcagctgagtaaggccgtcggcaattttgctgagcagcgcctcaagccgttttccttccacagttgaagggtcaaggatgtttttgtactggctgtttgagatggccgttttatagtttccggatggaaaggccggatttgcgagatgcaggctgacctgagggaggccgccgcttttccagtatgagattaagctgctgttgcagctgtaatcgatagtatcggtgatatccgctgtttccagccaccctctcccatagtcacagccgtagatggcgggagactgtcccgtcgcgtttttcaagcggttttcctctgtcattgaaaaagtgacatcactgtacccgccgaacgctccggacatgaccctgttttctgaacggttgggcaggtgggccagccagttcatgatatcttttgtcgtctgctgggcatttgggttgacgggataaacggtgtgagccgatatcggactggcggctcctaagagtaataaaacgatagacaggcagactgctaactttttaagcatataaaagacctcctgatttttaagatgatgaaggatgtgaaacgataacctcacaatctccttctataacaaaatctccggaatccgccggcacgataaagtgatcgcctttctgaacggggcatccatccagttctccgcgccctttaatgacgcttgcgagtaaataccggccgggtgcggggaatgatgctttcccgctcacatcccattgataaactgaaaagaaaggtgtttcggcgagtatcgtaataagagcatctccgatccgatgcttagtgctttttacattttcatcggtatggggaatgtctgttacgtcaattgctttctcaagatgaagctcgcgtttattcccgttcccatccgtccggtcatagtcgtaaagccggtaggtggcatcagagctttgctggatttcaaggacgagcgtaccttcacataaagcgtgcagtgtgccgctcgggacatagaaaaagtcgccgggcttaatggggatgcggcggagcaggtgatcccactcgtttcgttcaatgagccgaacgaaatcttcttttgtttgggcgcggtgccctaaaatgagctccgcgtcttttttgcagtccaacacgtaccagcattccgtttttccgagttctccgttttcatgccgatgtgcatatgcgtcatccggatgaacctgcacggataagtccatatttgcgtcaagaatttttgtgagcaggggaaaagcttcttctttcggatgtccgaacaggtcagggtgttcattccagagacggtgtaatgatgttccggaaaatggcccgttccgcacgatggatgtaccgtgcggatgagctgaaatcgcccagcactctcccgtccgctcagaaggaatctcatacccgaatgtatcgcgcagcttcgtcccgccccataatctttctttaaaaaccggttccaaaaataagagtttcgtcattttcccgcctcccggtttgccgtctctaatgcgcgctccgccaatacgagcgaaccggccgcgccggagtgaatccctaattgagggggaccgatgaagtgttcaatgtcgggcagatcaatatattgattcagccgctttttcacgtgctgacggatataagagaacagctgatgctgcttcatgacgcccccgccgagaatgatcttttccggcgaaagtatgagaatatactgcacaagcgcttcggcaatataatagccttcaagctcccacacttcctgctgatccgccagcagatatgcttttttcccccagcgtttctcaatggcgggacctgccgcgaggccttccaggcaatctgtatggtaagggcaattgcctttgtagccgtcgtccgggtgtcttctgacataaatgtggcccatttcaggatgagacagcccttgaacaaatctgccgttcatgatggcgcccgctccgatgccagtgccgaccgtcaaatagaggcagctgtccgcgtttttggccgcgccgaaagaagcttctccgagcgccgccgcattaacgtcggtggtgaagcctgcgggaatatgcagtgcgcttttgatcgtttgaagaatagggcagttccgccaggctgtcttcggcgtcgcggtgatgcacccgtatgtttgactgtcggggcggatgtcaatcggtccgaacgacccgatgccgatggcttctatcgggaaatctttaaagtaacggatgacttgtctgagtgtgtcatccggttctcccgtcggaaactccgccctgtccagaatggtgccgtctttttgtccggcggcacagacaaatttcgtgccgccggcttcaatacctccaagcatggctgtacctcctcatctgttaaaatccgttttgatcggaaacggctttgaaccagcggccgctttttttgacggtccgttcgcccccgttttccagattgacagatacaaagccgtagcggtttttataagcatttgtccaagaccagttgtccataaaagtccacaggtgatagccttttacatttgaaccttctccgatggcccgatgcacccatttgagatgttcccggataaattcaatcctgtaatcatcctgaatgatgccgttttcatcgcggaagcgttcctcgccttcaactcccatgccgttctcggaaataaaacattcgatatttccgtaatgttctctgagattggtgagaatgtcatagattcctttttcgtatatttcccacccgcggtgtgggttcattttccgtccgggcataacatacggatcgaagaaacgctcaggcaggaaaggggcgtgcggattcggaacatgttcttttgccttgacgcgtctcggctggtagtagttcacgcctaagaggtcaaccgtatgctcctgaatgaggcggagatcttctttctcgtaacgcggcagaaagccttccgccttgagaatctcgacaagctcctcaggaaattcgccctttacggcgggatctaaaaatgagcggttgaaaaaggcgtcggcaatccgggatgctttcagatcttcagggtgtgagcttctcggataagaaggcgtcagattcagaatgattccgatttgtccgtcctgtttcaattctctgtaggctttgacagcccttgcattcgacagcagggtatggaagccggcctgcaccgcttcttgaaaattaacgtgattcggatagtgaaagtcgtataagtagccgccttcaatcggcacaatcggctcgttgtgagtgaaccattttttcactttgtcaccgaatagcgaaaagcatgttttggcgtaatgttcaaacgcgtcaacggtgtcccggctgacccagccccccttacgctgaagggcgagcggcatgtcaaagtgaaacaaattgacaaacggctcaatgcgatgggcaagcatttcatcgatgacgtcctgataaaacgcgaccgctttctgattgacctcgccagttccgtccggaatcaatcttgaccaggaaatagacagccggaaggagttgtggccgatttctttcatcagccggatatcctccttgtattgatcataaaaacgtgacgtgtcgccggggccgacgccgttaaaaaaacggctcggctctttttcataccagtaatcccatatgttttggctttttccgtctttgtcggcggcgccttctgtttgggtggcggaggcggaagacccccaccagaatccttccggaaaacgatattgaatatttgattcagtcaattgatttctctcccttactgcgattttgattacatactcatgctgtcatcccgtgcttgctgctcggcctcggcttctttttcctttgccatgtttaatttgtccagcgctttaagaaacgggaaccagataataaacacaatacagaggttgaccagctgcataatgccgcccatgacggaattggtcgccataatcccgttaatgaaaagggggacggtccagggcacggtcacgccagtaggagggggcacgatccccgccgacatggccaggtaggtgacgagcgtgacaaccatcggtgcgatcacccacggaatgataatgatcgggttcatcacgatcggcaaaccgaaaataaccggctcattgacgttgaaaatgcccggcgcgagaccgagtttggatatctgtttcatctgtttgcttttcataaaaagcaagatggtgatcactatggccaatgtcattccggttccgcccattccgacggtgtaaatctccataaacggcttagaaataatatggggaatctcttttcccgctgtatacgcagccaaattttcgacctgtaatgtattccagatcgggtccatcacggaattgataatgatctgtccgtgaagtccgaaaaaccataaaatctgaataaagaaaacagcgattaatgtaggaatgatgccgcttccaagtccgacaagcggggcttgaaccgtatgataaatgacatcatgcagattggtgtgaaagatctgggtgacagccgcattgatcaagaggaagacggtaagcgtgataaaagccggaatcaatgcggcgaacgatttagcaacagccggaggaacaccggcaggcatcttaatcgttaagtttctctggacgattcttctgtagatttcacccgacaaaaaagcggttatcatgccgagaaacatcccttttgctccaagccggtcaaccggaatgacgcctgcgaccgctttgcccgtttccggctctaagacgaacggggtgagcagcagaaaagaaaccaatgcaatcgctccgccgaatacggcctccacttcgtagctttttgaaaggtaatagccgatcccgaagacgacaaaaatggacataatccccatcgtcgccgtcgaagcgccgccaaatccggattgaaagacagacagggcggagctgctcatgattttgtttaaaaacggcaggttcgtcagcacgacgaacaccgaaccgaaaatggtcagcggaaacgccagcataaaagcatcccgtaagacttgcaggtagcggttattgtttaatttgcccgcgatcggaacaaggaattggctgattttctcaaacacgtcttcacccccggctttttataaattctttgattgaaataagtcgagcatttctttgacgatctctttcattgagagcgctgacattaagtggtcttcagcatgcataaaaagcagggagacatccgtcttggcgccgccggcttctttttgaatcatctgaaaatggatgtcgtgcgcttttcccagttcttcttcagcctttgtcagaaaggtgtctgactcatctggccggccgtctttataagcgcgtatcgattgaataatacagctgcgggcattgccgctgtgaagaatcagctgaaaactgatctgttcatccgtgtacgtttccatgcttatcgcctcctttatttgttctctatcaaggaaacggcctgttcgtatgcttttttgccgtctcccatgccgtatgccatcatatcaatcacatcaacggtgatgtgaagcgggtccgcctctttctgaagctcgccttttaaaaaactcatctgcgggccgatcagtacgacgtctgcgtctttcatcgcttcttttgctttatcctgtccgactgcccaaatctcggcctcctcaccgatggagctggcgtaattctgcattttcgtcacaagaaggctggtggacatgcctgagctgcaggctaataaaattcttttcatgaggaatcccttctttcataaagttaaaacgttttcatgaatattataatcttttgaaattaaatgtctatacttttaaaatataaaagttttacttttcggatttttgacacaaaaaaaccttttaagattcaacttaaaaggtttttcatctcaagcgagccataacagccataaataaagtccgatcagggtgatgaataacgtcggaatggttaatatcagacctgttttgaaatacattccccaggaaattttcacgtttttccggctcagcacgtggagccataacaatgtcgccagcgacccgatcggcgtgattttcggcccgaggtcagaaccgataacattcgcgtaaatcaatgcttctctcagcagcccgtgagtgtccgttccgttgatggctatggcgtcaatcatcaccgtcggcaggttattcataacggaggagaggatcgcagcgataaaacccattccgagtgtgcccgcaaacaatccgtgatccgccgctttctgaataagctgagaaagaagatccgtcagtccggcattccgcaagccgtacacgacaacatacatgccgacagaaaaaaacacgatggcccacggggcgtccttgatgacttgtttcgcagggacggcggggcttcgctgcgccagaatgagaaaaatgaccgcgatggagccggcaacgaaggaaacgggtatcgacagcagttcgctgacgaaatatccgatcaataaaacggccagcacagcccacgataaccggaaaaggcgttcatccttaatcgcggatgccggatgtttcacaagaccggtgtcataccgtttcggaatgttttttctgaaatagagatacagcaccaaaatgcttgccgccagagaaaaaaggttgggcaccagcatgcgtgttgcatattcaatgtacccgatatgaaagtaatcagcggatacaatattgaccaaattgcttacaacgagcggaagcgaggtggtgtcggcgatgaatcccccggcgataataaacggaaaaaccagcttttcaggtaaattcaaagcccgcaccatcgccagtacgatcggcgtcaaaatgagcgccgctccgtcattggcaaacagggcggagacaacagcccctaagaccgacacatagagaaacatccgcagcccgctgcctttggccgccatggccatatgcagcgcggcccactcaaaaaaaccgatactgtcaagaattaatgaaatgataataatggcgataaaggcgagtgtcgcattccagacgatccccgtcacttccgcgatatcgtgcaggctgactgctccggcgatcaaagcgaggaccgctccgccgcaggcagaccagccgattgatatatgtttcggctgccatatgacaaacacaagtgtcagcacaaaaatcagcgctgataaaaccgcaactcccaagaatatatcccccttaccggcatgtaacagtgacttctttttgccgcaatgtctgtaaaacttcgtccttttcatctatctgctgcagaatcgagcaaaccagcgcgtattccggtccggacggatgaatggcatagtaccgccactggccctcgcgtctttcgcgcacaaggccggcgttctttaatttccgtaagtgctggctgatgccgggctgacttatatgaaaaatagccgtcagctcgcagacacaatattccttatcctccagaagcttcagcatcaaaagcctcgtcgggtcgcttagaagtttgaggcactggctgatcccttcggaacttaaagcattatgccgccgttccatgcgctcactccttttttacactattatataagcagacatttatataagtaaacggcaatataaaaaaagccggtcttgcactttttgcaaaaccggctcatgtttatttttggaacagttttttcgcttcatccattgctaatttatttcccagtgccgaataatcaagccaaggctgatcggcaattttatagacatggtttgctttcacggccttaagccctttccagacagcgcttttttgcaattctttataggcttgctgtgacttgtcgtctctgttaacgaccacgaaaatcgcatctgcgttgtaatcaggcagcacttcttgagaaatgacttcataagggcgggaggtattcatttctttaatgccgtcagccggtttcagcttcagatcgtcaaacagaatcggtcccatcgggcggcgtgtgctgaagacgcgaagctcttttgcgttcacgcggatcgccatgactttggcgtttttccctaattccttattcatcatggatctgacttgttttgtttcatcttcgtaatcttgaataaatgttttcgcttctttttcacggttgacgatttttccgatgtcttttaaatgatcacgccatgtgcctttatcaaggtcgaaaacgtgtgtgtttccgattttcttgtatttagacacatcttttcccgcaaattctttatcaagataaatgttgtctggattcagctcaagtaaagcttccatatccgggtctgaggcaggtccgagttttttcgtgtctttcagctgatttttcacatgagggagaaaatcttttaattctccgcccacgacggaaccggcaggtgtaacgccgagagccagcagatcatttgtcaggtgaatggacatcgaagcgattttatgatcgccggatttcttttttgactccggctgtgatgaatcggattggcaggcagccagtaagaaaatacacatgaaactgatgagcgcaattatttttttcatgggaatactccttgttttatgatttgattttcatgacgagatagagaaaatacggcgcgccgatggctgccgcaaccacgccggccggaatggcgttcggctgaaacaaagaccggccgatggtgtctgccgcgacaagaatgacaaggccgattaatccagcaatcggaataatatgctgatgcatggtgccgacgagccgtcttgccaagtgaggggcggcaaagccgataaagccgattccgccggccatcgcgacgctcgcgcaggacaagccgaccgctatggcgatcagcatgatcctttttctctgcacgtgtgcgccgagccccgccgctgcctggtcaccgagcattaaaatattcaaagaccgggcgttaagccatgcaagcggtgcgagaatgccgatccagggcaaaagcgaccacacgtgaatccaatctctgccccagacgtttcccaccagccagcgggaagcgaaggtataagtttcttcattcaggcgcagcgacataaacaatgtaacggcgctgaagcccgcggaaacggcgatcccgaccaacagcatgcggatcgttaaaaaaccgttcagcctgtcgtacgtaagcactacgatcagcagggcggcgagtgttccgcccgcaaacgtaaacagcgggatgaacatcgacgcctgcgcctccagggaatgaaagaatgtgatatacatcatcaaaccgaaggaagcgccggcatgcagtccgagaatgcccggatcggcaagcggatttcgggatacaccctgcaaaatagcgcctgacacgcctaagccgataccggccagcatcgtcaccagtatccgggggagccggtaatcgaataaaacggttgtgctttgaaacgtgccgtaaccgaacagcgtttttcccacggtgaggggagaaagccggaatgagcccgtgtgcagcccgatcagaataatgcaaacggcgatgaccagcagaacgagacctgccgccgccgctttttttgtttctttctgcactttcatttataagtctctcccttccttgcgggcaatataaagaaagaaagggacaccgacaagtgccaccatgatgcctatcgccaattctctcgggggactgaccgtgcgtgaggccaagtcggccaaaatcaaaagaatcgcgccgagcaacgcggacatcggaataatcagcctgtacgtaacgccgacgatcttgcgggcgatatgaggaatgaccagcccgacaaagccgatcgcgccggcagcggaaacagacacaccggcaagaacgacggcgatcattaatcccgcggcacgcgtcagagccgtgttcacccctaaattcgccgccacgtcatttcccattgagagaagggtgacggaccggcccatgaatgtcgcgagaatgatgaagaccgcaatcacgggaacaaggacttgtaaatgagcccacttgatccccgacaccccgccggcgtaccagaaggccaaatcctggcttaaatcgtaataaatcgctacaccggtactgagtgaatgtaaaagcgcggccacgaccgccccggcaagcgtcacctttaaaggtgtcatgctgccttttcccgccgcactgataaagaaaatcaagccggtgcttgccagtgctcccaaaaatgacatcatcatcagcagggcgtatgacaaatgagggaaaaaagcaaagctgagcgcaacaacaaacatggcgcccgcgtttacgcctaagacacccgaatcggcaagcggatttctcgtgacaccctgcatgagggcgccggctgcggcaaaagcggctcctgtaacggccgcgccgagcactctcggaagacgcaattcatgaatgatctgctggcccgttatgttcggattgtaatcagcaacagccgaccaaaccgtatgtaaagtaatgtctttcgcgccgaatgagacggcgaaaaaaatagaaacaagcagcccgatcaccgcgatcaggaagaaaaccccgttttttaagatgctgatcagacggcttgcggacgtgacagaatcgctcaaaaatcaattcacctacttttatgatcattgtccggcatttattgaatatgagaatcattttcatttgaaccatcatattataccgggccgattttcaaaacgcaatagagtgttcaacaatgatgcccttttttctttcatgtttatattgtaaaaaagaagtgaaaaacgtgaaagaggaaatcgctatattcagaaaggagggaggcaaatggcgggagaaggaaagcctttgccgattgaattttaccagagaccgtcagtggagcttgcccctttattgctcggctgtctccttgtgaaggagacggatgagggaacggcttcaggttatatcgtggaaacggaagcttatatgggagcggatgaccgggcggcgcacagtttcggcaaccggcgcacgaaacggacggaaattatgttccatgaggcgggccgcatttatacatacgtcatgcacactcatacattaatgaacgtcgtcgcctcggacatcggcattccgcaggccgtgttaatcagggcggcggagcctcatgaaggacagttcctgatggagagcaggagaccgggcagacccccgagagagtggacaaacggcccgggaaaactgacgaaggcgatgggcatttcaatgaacgactacggcggcatgatcacggaaccgccgctgtatattacggagggctttacgcctgaacatatatcaacaggcccgagaatcgggattgacaacagcggagaagcccgggattatccgtggcgctattgggtgacggggaaccggtatgtctcacgctgaccatgtttataaacgctgataacaggggaaagacaaggtaaaagaaaggggattcagacattgaaaaaatttttcaaaacgattatcaaatgggcgcccgtcatctatccgattatcagaaaaatcataaaagaacggaaggcatctaagcggaaccgcatgtccgcatcccgaacagccggctgatccggctgtttttttacggtcttggcatcggattgccgcattgacttgaaatcctccccagtatagaatttacatacatttaccccttcctcattctttttgcccatttttcacatctgcatctgatctgataggaggtttttctcatgcttcatgggcggcttcgtgaacttctgcgcttgcttttagctgctgaaacaccggttacaagctcagtcatcgctgcaaatgtaaaggtaacgacgcggacggtccgcaatgacataaaggaactgcaaaccattgtagaaaaacacggcgcatccattcaatctgtcagagggagcggctataagctgctgatccggaatgagcagccgtttaaaaactggcttcaggacaatttccagcagaacagcaccgtaccgatttttcccgatgaacggatagattacctgatgaaaagaatgcttctggccgacggctacctcaagctggatgacttggcggaagaactgttcatcagtaaatccacacttcaatctgatttaaaagaagtcaaaaaacggctccgcccctatgacatcattttggaaacaaggccgaactacggctttaagctgcgcggcgaagagctccgcctccgttattgtatggcggaatacttagtggacgaccgcgagcccgagcctgatctcctgagtgaaaaggccggtattctgccgaaagacgacattcatgtgatccgcacagccattatgaagcaggttcgaaaccataagatcccgctttctttcttcggcctgaacaatctcatcatccatatcgccattgcctgcaaacgaatccggacagaaaactatgtatctctcattccggaagatcttcatgatattaagctcgaaacagaatatcagtcagcggaagccatcgtaaaagagcttgaatctgcgctttcggtcacctttcccgaacaggaaaccgcctatatcgccattcacctgctcgggacaaagcgcatgacccagtcacaaatggaaggaaaagagcttacaaggctgatagacggggaaaccagccgtttgacggaggccatgattgaagccattgagcgggagctgaagctcggaatcacggacgacaatgagctgaaagcgggtcttgcgctccatatcaagccggcgattaaccgaaaccggtacggaatgaacctgagaaacccgatgctctccgccataaaggagaattatccgctcgcatttgaagcgggagtgattgcgggaatcgtgatcaaggagcaaaccggcattgatattcatgaaaatgagatcgggtatttggcgcttcatttcggagccgctattgaaaggagaaagacggaacggccgcctaaacgctgtctgattgtctgtgcgtccggcgccggcagcgcgcagcttttaagagaaaagctccgttcccggttcgcaaaacgtcttgaaatcgtcggaacggctgattactgcagccttgaccagctttcctttgagtcgattgattttgtggtcagcacagtgccgatcaaaaaagacctgcccgttcccgtattgaaggttcatacgctgctgggcggcggggattttacaaaaatcgacgccatgctggaagaaaatcgggaacaattgaactttctgaaaccggagctggtatttttgcagcaggatctggagacgaaggaggacgtcatccgttttctcggacagcaggttgcagaagccggcctcgcttctgattctctgaccgattctatttttgaaagggaagcgatttctcctacgagtttcggcaatcttacggcgattccgcacccgctcgttccgcagacagacacgacgttttgggcggtatgcacgctgaagaagccgattgactgggcggataagcgtgtccaatttgtctgcctgctctgcgtcgagaaagaaagcaaagccgacctccagcatatgtacaaatggctcggcggcatgttggatgatccggccgcggtaagccgtctcttaaaatgcacaacctatcaggaggttttacgagtattcagagacaaacgatcagagaaagaccgggatacaccttttttccgttagcagcggaaaaagcctgagtagttatgaaagcgatttcataatatgatgttactaacatcgagacatacaaaatatcaaactttcaggaggtcttttacatgaatatattactcgtttgtgcagcagggatgtcaacaagcttactcgtcaccaagatggaaaaaagcgcgcaggaacaaggaaaagaatataaaatctgggcggtgtcaggcgattcagtcaaccagcatattgataaagcggacgtattgctgcttgggcctcaagtccgttatttgcttccgcagctgaaaaaattgggtgaatcaaaaggagtgccggttgaagtcatcaataccgtccattacggcacttgcaacggagcggaggttctgaaatcagcggaacagctcggaaacgcatcgtagaaaggggcgggccgtgtgaataaggtgaaccagtttttagaagagaaagtcatgcccattgccggaaaaattgcctcccagcggcatctgcaagcactgcgtgacggaatcatcctcaccatgccgcttatcatcatcggttcattttttctgatcatcggcaacctgccgattccgggatatgcggatttcatggcgaagacgttcggaagcgcctggtctcaaaaactgcaatatccggttgatgcgacctttgaaatcatgggccttgtcgccgctttcggaatcgcctaccgcctggctgaaaaatacggggtggacgcattatcggccggtgcgatatctttggcggcgtttctcttggcaacgccgtacaaagttccgtttctgccttccggcgcaaaagaggaaatcatggtgggcggcggcatcccgctgtctctcatgggaagcaaagggctgtttgtcgcgatgatcatcgccatgctgtcgacggaaatttaccgcctgatcatccagcggaatttcgtcttcaaaatgccggacggcgtgcctccggcggtcagcaaatcatttgtcgctttaattcccggctttgccgtcatctttctgatctggggtgcgcgtttaattgtcgaagcgacgccgtttgaaagccttcataacattgtaagcgttgtactggggacgccgctctcgattcttgggggaagtctcggcggaagcctggtagccgaagcggttcaaatgcttttgtgggcgtgcggattacatggggcgaacattgtcggcggcgtcatggcgccgatctggttcggagcgatggatgccaaccgtgttgcgtttcaggcaggcgatgcgctgccgaatattttcacccagcagttctttgaaatctggatcaacatcggcggaagcggcgcgacactggcgctcgtggtcaccatgtttctccgttcgcgaagcaagcagatgaagcagcttgggaaactcgccatcgggccggctgtctttaatattaatgagccgattattttcggaatgccgatcgtcatgaacccgatgcttctcattccgttcatcatcacaccgcttgtcacactggtctttacctatatcggcatgagcacaggcctcgtcgccaaacctgccggcattgccgtcccatggacgatgccgccgattttctccggctatcttgccacgggcggaaaaatatcaggggctgtcatgcaggcgattaatatcatcacagcctttatcgtgtactatccgttcttcagaatgtgggattcgcaaaagctgaaagaagaaaacgaacttgaacaatcgcaggcgccagccgtacagggagacgaaaaagccgtgctgtagagaaagggagtgaaacacatgaatgaaaaaatggaacagaccatttttcagatcatcctgcatggcggcaacggcagaagcgcatcaatggaagccattgccgccgcaaagcagggggacagagccatggccgaggaaaagcttcaggaagccgcaagggaactgaccgaagcccatcattaccagacagaattgatccaaaatgaagccggcggagaaaaaacagacatgacgcttttaatggtgcatgcgcaggatcatttaatgaatgccatgaccgtgaaagacttggccgctgagttagtcgagatttacgaaaaagtgagtctgcaagggggagcaaaaatatgacaaaaagaattaaaattgtaacgatcggcggaggttcaagctatacaccggagcttgtggaaggcatcattaagcgctatgaggaactgcctgtcagagaattatggctcgtcgacattcccgaaggcgagaaaaaactcaatatcgtcggcacgcttgcaaaacgcatggtcgaaaaagcgggtgttccgatagagattcacctgacgcttgaccggagagaagccttgaaggatgcggatttcgtaacgactcaattccgcgtcggtctccttgaggcccgcgccaaagacgaacggattccgttaaaatacggcgtaatcggccaggagacaaacggtccgggcggtttattcaaagggctgcgcaccatcccggttattctggaaatcgcgaaagacatcgaagagctttgtccgaatgcgtggcttgtgaatttcacaaaccctgccggcatggttaccgaggccttgctccgctactcgaatctcacaaaagtcgtcggcctctgcaatgtgccgatcggcattaaaatgggcgtcgcaaaagcattggatgtggatgtcagccggatcgaagtgcaatttgccggactgaatcacatggtcttcgggttagatgttttcttagacggcgtcagcgtgaaggatcaagtcatcgaagcgatgggagacccggaaaacgccatgacgatgaaaaacatttccggagcggaatgggagcctgaattcctgaaggcgctcgatctgattccttgcggctaccaccgctattatttcaaaacgaaagaaatgctcgagcatgaaatagaagcttcacagacggagggcacacgcgccgaggtcgtgcagaaggttgagaaagaactgttcgaactgtacaaagatccgaatctcgccatcaaaccgccgcagctggaaaaacggggcggagcgtactacagtgacgcggcctgcaacctgatcagctccatctataacgacaaacatgatatccagcccgtcaatacgataaacaacggcgcgatcgccagcattccgaatgactcagcggtcgaagtgaactgcgtcatgacgaaagacggtccgaaaccgatcgccgtcggtgatctgccggtgtctgtccgcggactcgtccagcaaatcaaatcatttgagcgcgtcgccgctgaagcagccgtcacgggagattatcaaacggcgcttcttgcgatgacgatcaaccctcttgtcccgtcagactccgtggcaaaggccattctggatgaaatgcttgaggcccacaaagaacatctgccccatttctttaagtcgattgaagcataagagcagtaaaaaaacccggattcgcttccgggttttttgcttattttgattcgcttagtgaggcgactttcgccgtccagccgaacacgtcggcttccgcgcctttttgaatgcctgtaatggtatcatacaatttcttcgagatctctccggtttcaccgctgccgatgacaagactttcatcattccagatcagttcgccgaccggagaaatgaccgccgccgtaccggttccgaatgtttcttccaatcggccgtcacgatgcgcctggatgatttcatcgatcgaaatcttccgctcagacacagtcagtccccaatgtttgagaagggtgatgacggaatttctcgtaatcccttcaagaatgcttccgttcagctccggcgtcacgatttcgccgctgattttgaagaagatgttcatgctgccgacttcttcgatgtatttcttctcaatgccgtcaagccataaaacctgggaaaatcccttctcttccgcaacctgctgcgctttcaggcttgatgcgtagttgccggcggttttcgcgtttccggtgccgcctttgacggcgcgcacgaattcgttttccacggcgatttttaccggtttaatgccttctttgtaataagagccgaccggggaaaggatgataaacagcttgtacgtatgggatgccgctacaccgaggaaaggctcggtcgcaataataaacggacggatataaagggaagtgccttccgctttcggaatccagtcttggtcgatggctacgagctgtttcaggccttcaagaacaagctcttcatcaatgagcgggatgcaaaggcggtcatttgactggttcaggcgctccatatttttctccggtctgaacagaagcacttcctgatccttcgttacatacgctttaagcccttcaaaaacggtttggccgtaatgataaaccatggccgcaggatccattgagatggactgataagggataattctcggatcataccatccttgatcggcgtcgtaatccataacaaacatatggtcggtgaaaattctgccgaacgcaaggttatgggggtccggtttcggttttttggctgaagtcaattcaacacgaatgtcttgtttcataatgttctgtctccctattggtgttattgtcaaacttatttgaaaataatttatattctattgtataccttcaacaaatattcgcaatagttttcctcaaatttgtgaaaaaatcaaatcacataaaaagcaggggagagaatgccccctgcgtgttcgtttttacatattctgtaatcatcgtgctcagtgaaccgtcaccttgccggttttgtaaaactgctccattgctttatcgacgtacacccagcccttccaggcgatatggatggtgtctttcataaagtacggatcatattcgtgcccggataagtcggcaacctgaaagcccttcgctttaatttgcttagtgacttttttgtagtaatcagtccggccttttttcgggaagccggtgtagtcataccattttccgttgaccggaataactacgaacatcggttcagcgccggcatctttcagaatgtccagcatatcctcaaagtcgtgatattcgactgatttggcgtacgttcttcctttgttgattcctttcactctctttactttcttcttaatctttttataagaagcgtcatcgatatagaaaggattggacttggagctccgttctcctaattgagcggcggctgtttttaactctgaccacgatttccctttcaggttttcagagatcgtccgttcagggcccttggtttctcccattgaataataaagatcttttttctcaagcagagaataataagctttggcagccggcatgaccgctttcactttccatgattgtccgttgaccattcccttgtataattcagaaaggacggcatcatgctgaacaactttaaaacggagcatgcgcttcatcatgttctttttgaccgcgggatcaatctggttattaaatgctaaatccaatgcctgaagtgatgaaaaattcggcgcaaagtgctgttcatcagaaccttttttgataaaccattgcggagaaacaatgaataccagctttttgcccttcagctgctgataatgcgccgcaaagttcacggcgtgtatcaaggattggtccccgccttttccgacaagataaggcgtaaagccttggttgttcacttggaaatagttggacgggtgaaactcatccagtcttgaaagctcggaagaaccgaaaatcggcatatacttcgagtcttcgaacattttgttttgcagatagaggccctggaacatattcggatttaaggccgctgccgactcttcgacacgtttttcaggaatgaagcgcgtaagccatgaagccggaactgcgatagctccgacaaacaggacaaacgctaaaataattggtccaaagaaacgctttttcatttacttcaactcagtcagtttgtttacaatgttgtttggcgtattccactcgtcacggtcaaattcagtgatcggcactgtaatgccgaagcggttttcgatggcgacaagcagttctacagttccgaaagaatcaagcagtccttcttcaaagatttcaatatcaggattttctttcacagcgtcctcctgacaaacttcagctaatacgtctaatacttcctgtttaaattccatgtgttttcaatctcctttagtgatgaaatggttttcctgagaaaatataaaatccgaaacatacgaaatggaatgtgatgacgatggctaaaaaggccgtaaaacgattggcgggcagccacttgtatttcttattccatttctcaaaaaagttatacccggtcattaatacggcgtggtaaaggccgtatataatatattgcagggcgagtccgtgccagacgcccatcagcatgaacagcaggaaatacccgatgttcgagacggccatccggttctttatccattttttctttgtcatccagaatacaaagcgcataaatacgtagtctctgaaccagaaggataaggacatgtgccagcggttccagaagtctttaatgtttttgctgataaacggcttattaaagttttccggagatttgatacccatgatatagcttacaccgacggcaaacatcgtgtaacccgcaaaatcaaaaaacaggtacaagctgtatccgtacatgtacagcacattaccccacagtttactgtgggtgatatgaggcagattcataatgaaatacgtgttaatcgcatatccgataatgaatttgtacaagaaaccgataaaaattttatgaatgccggtatacagtaaatcagcgtattctccctttgtccatactttctgttcgtccttggcaaatctgcggtatctgtcgatcggaccggaagaaatggtcgggaaaaacataataaagtacaaaaggcggtgaagcggcattttttctttaatcagtccgtctctcgtttccatgatcagctggacgcctttaaatgtcaaataagaaattcctaagaaactgatcaggttatgaaccggatgatgaggcgccggcgggaagaaaaacggccataatttagataaaaacaggggtaaaatggacgcgatcacggccatactgaagacaaagccgctgttggctttcagtctgtaagcgagataacccctgattaaaagcacctgccacagcgtaaagatacatagtgcgatcacgccgtgcagatcatgcgcgaaaatcaaagccaatacgatgatggatataaacatgttgtatccttggaatctcttgccgttcagccctaaaataatcgtcggcaaaagaaggattccaagtaagataaagaagaaaaacgagctgtaaggcgtcatacaagaacctcttcgccaatgcgtttacggtcgatttttccgttcgcagtcatttgaatgtgatcctgataaatgaattttctcggaatcatgtaggccggaagcgaagcggccagttcttttttaatggcgcttgtcagctggaattctttttcaaaatcatgtttttcaggcacgatggcggcaattaaatattcgactggtccgttaggctgatacgggatgacaaccgccgtctgcacatattgagactgccttacatgtacttcgatttcctccagctccatgcggtagccgtgaagcttaatctggaaatcaaggcgtccttggcagaaaatctgaccatcctgaacataaccggcatcacccgtgtgatatgcccactggccgtcaattgagaaaaacgctttttccgtcagagacggttcaccgagatagcctttgctcacgctcggcccggcgatgatgatttcccctttttctccgtccggaagcttattcccgttttcatccatgatgaagatattcatatcgggttttgcaaaaccgacgggcagagattcattttcatcgataatctgctgcgtaatttcaacggaggtgacggcaaccgttgtttcagtcgggccgtatgtattgaatacgcgggccttcggaaaacggtttaacagttcctgtgccacggcagccggaagcgcttctccgcaaaacataaatacttctgcctcaggcaggagctcctgcgtaaagccggggtccatcagacacatttggacgaaagacggcgtcgatgtccagacgttcagtttggatttctccagctcttcaaatagtactttcggtttattgattttgtctttcgttacgcagtgcagcgtacctcccgtttgaagcgacgggaaaatgtccatgacagataaatcaaaagaaaacggagcttggtttaagaatgtcttacccccgcccacaggaaaatccctgcagatccagtcagtgaagctttgcaggttatcagccgatatctgcacgcccttcggatttcccgtgctgccggacgtgtaaataatgtaaaacgtatccagctcttttacccagttctcacggctgaggtctgcatctccgtcagctgcaagctcttcgggcgtaacggttttaatcagattgcttcccgtatcgactgcatcgcccgatacgctgataagcagctctgcgcctgagctttcaatgattttgacgatccgctccgccggaatggaaacatcgacagggatgtaagggcggcccgctttgacgcttcccaagaaagaaacaatcatattcggctccatatgtccgtaaaccaggacaggcgctttcgaaccgtcagctgtatgtttttgaatgccggacgcaacccgctccgacaaatcccataattccccgtaagtgagggaatgatctaaggaacgaaacgcttcggcctgcggcttggcgtctgcgtatgtttttatagcatcaagtagtttcatagttatcctccccgattagaaatcgttgtaaatataagtgccggtattcgctgtatgaaatccatacatccaaaagagcaatactaatatcagaaaataaaagcccgtatgaaacgtccatttgatcaatgtattttcataagcacgttttaatttttgcatcatattcaaaattccttccccgcgtattcaataattacaccagtatatgacgattagattaacaaaaagtttcaaaatatgtctaatatcctaagcttaaaatttccttaaaaatgaatgagaaacaaaaggatggaaaacacgcatgtataaattggcaaatgatcatactaaaaaggcgctgttcaggcgggatttttaacttatcgtaaatataaacgaggtaaaaaaattttggcggctttttcttaagcaggcttgtgccgaaccccaagggagaagggcgaaaagccgtttccggcaggatagctgataaagcgccgcatcttgtgaaatgaggaagaaattattatgatagataaggtagcagaaaacgtgaaaaccccaattcaacactactgttatcggctgactgtgaaagccttttaatagaaaggaagaggaaaatgaatcaaaacaatatggggggcagccaaaagacgcccgagaaagaaagcatgggccgcattttgtggcagctaacccgccctcatacattgacggcatcgtttgtgcccgtacttctcggcaccgtattggcgatgttttacgtaaaggttgatttcctgctgtttttggccatgctgttttcctgcctttggatccagatcgccacgaacttattcaatgaatattacgattttaaacgcggtttagatacggaggattccgtcggtatcggcggagcgatcgtccgccacggcatgaagccgaaaacaattctgcagctggcgctcggctcttatgcgattgctctcgtgctcggtgtttatatctgcatgagcagcagctggtggcttgcggctatcggccttgccggcatgctgatcggctatctgtatacgggcggcccgctgccgattgcgtatacaccgttcggggaactgttctccggcatttgcatgggctctgtatttgtccttatttcttttttcattcagacaggcagaattaatgaacagagcattttgatttccatcccgatcgccatcctggtcggagcgattaacctgtccaacaatattcgtgatattgaggaagataaaaaaggcggacgtaaaacgctggccattttgatggggcatagaggggccgttatgatactggcggcatcttttgccatcgcttacatctggatcgtcggtcttgtcatcatgggttacacaagcccgtggctgttcctggtctttttgagcgtgccgaaacccgttcaggccgtgaaaggctttgtgaaaaacgaaatgccgatgaacatgattattgcgatgaaatcaacggcgcaaaccaatacattcttcggattcctgctttcaatcggactcctgatcagttatttccgctgatcaaatgaaagggcaaatgctataaccggcatttgcttttttttatgacataatcttcacgatattgtaaagaacctgaccgcggactgacccgtctcatatatggacagcaaagcaaggagatgaaaaaaatggacttgtcaacagcccatatggatgatttaaaaacggtcatggaagattggaaaaatgaattattagtttataaattcgctttagatgagctggatacgaagttttctatcatcagccaggaatataatctgattcacgggcataacccgatcgagcatacaaaatcacgcgtgaaaagttttgaaagcatcgtcaataaactgatgcgcaaaggctgcgatgtgacgacgcaggaaatgaaagagcatattcatgatatcgcgggtgtcaggattatctgttcctttatttccgatatttataatgtcgctgaggttctgaagcagcataaggacctgaagatcgtaaaggtgaaggattatatcaaacatccgaagccgaacggctaccgcagcctgcatttgattattgaaattcccgtttatttgacgaatcgtgtggaatatgtgaaggcggaaattcaaatccgcaccatcgccatggatttttgggcgagccttgaacacaaaatttattacaaattaaataacgaagtcccaaagcatctgaccgacgagctgaaggaagcggcggacatcgcccattatttagacgaaaagatgcttgggattaagaaagaagtcgattaaacgattgacccgtcacaaccagccggaccgctattatacgcagtccggctggttgtttatccgtttatgcgcagctgtacaaattttcgcctgcccacctgaatcgtcatgccgtcttctgcggtaatgacggtatgaagggcatccgttttctccccgttcactttgattccgccgttttgaatcatacggcgtgcttcgctttttgaagaaaagagtccaagcgtgacaagcagctcaataaggggcacggtcttttctccgtcccatatgacggttttcatatcttcaggcaggctgttttgctggaagacacgtttgaaatgccgctctgccgcatccgccgctttcgtgccgtggtacattctgacgattgtacccgctaagatcattttggcatctctcggatgaagctttcctgattccaaatccttctccatctgttttttctccgcaggctctaagtctgtcgctaaatggatatatgttttcatcaggctgtccggcaatgacatcgttttgccgtacatgtcgttcggatgctcgtcaatgccgatatagttgttttttgatttagacattttttcaacgccgtcaagaccttccaaaagcggcatgaggatgacgacctgcttttcttttttgtagcgttcttggaaatggcggcccatcagcacgttaaaatgctggtccgtaccgccgagttcgatatcgctttcgagaacgacagaatcgtaaccctgcatcagcgggtaaaagaattcgtgaagtgagatcggtttttgcatggcgatgcgctcctcaaagtcgtcgcgctccatcaggcgggcgacagtaattttccccgctaattcaatcacatcttccagattcaatgtcttcagccattttgagttgcagtgaagttcaactttgtcttgatccagcaccttgccaaactgttcaaaataggttttggcattgtgttggacttcttcatcagtcagctgttttctggcttgcgacttccccgtcggatcaccgatttttccggtaaagtccccgataacaagctgtatgatatggccgttttcttgaaattggcgcagtttgtttaacacgacggtatggcccaagtggacgtcgggtgcggacggatcaaggccgagtttaatgttcagcggcttgccggatgccactgatttggcgattttatttctcaattcttcaggcggtatgacgtccgcggcgccggtcatgtacaaatccagctgcctttgcacttctttttcctgatcattcgttaaagtgattgattccatcttttacatcctcctttttttagccaaacaaaaaagccgcatcccaaaaagggacgtggctgtatgcacgcggtaccaccctgattgaagacgaaacgacgtcttccgctcattcgaataacggtttcccgttctttgctactgaagttcacaaagaaagctcagggaggtaattcacgtttgtctttgtgccggcttgcaccatccgccggctctctgaaacagggagacaatccgttactgattcccgtcatagctgctatgttatgaaattgtcagcgattttttgcagcagggcggacagcgttttttgttcctgtttatccagacaggccgtcagttcaatttccccctgatgaaagtcggggtacagatcttcaataacctttctgccctcatcggtaatactgacgaatacaagcctgcggtctcttttgttcgtttgtctgctgcataagcccttcttttccaaagtgttcaggacattgctcgccgtcgccgaggtaattccggatagagcggctatccttcttgtatcaagcgtttcccattcacaaaggtcatacaggatggaaaacgccgtccatgataatttgtgtgccgacagcacctctttctccatttttacacggagctgctgggcggaccgatagagtgcagctgcaatataggccgcctctttgtttcggccggatagatcggaaaaaggcctgttcggcttcttattgtctgatccggcatcgttgcgaatcgtcaatggcgtcatgctccttattattgtcagaatcattagctatgaaatgaattttaacagagaatgcgaaagatatcaaatcgcaaacagcacattcccgcagaaaaaatgtgtaagattgaggtttactttttaaaaaaagggaaagacatttgtacaacaaaaagggagatgaatatcagtgggaaagaatgaaacaatgcatatcgtatcatgtgccgatgataattatgctcgtcatttgggtgggatgttcgcttctttattgatgaatatggataaaacaaggaatgccaaattatatgtgatcgacggcggaattactgccgaaaacaaggacaagcttgaacagactgcgatgtcattcgggacgccgcttgaatttttagaagtagacgctgatcaatacaagcatgcagtcgaaagcagccatattacaaaagcggcttattaccgcatttctatccctgatttaattaaggatgagtccgtaaagcggatgatttacatcgattgcgatgcaattgtgatggaagatatttcggttttatgggacttggatatttccccggcaatagttgcggcggtagaagatgccggacagcatgaaagactgaaaaaaatgaatatcagcgacactgccaagtattttaattccggtattatgattatagatttcgaaccttggagaaaacagaatatttccaaaaaagtgattgattttatcaatgataacagctcggaggattttctcgtgtttcatgatcaggacgcgcttaacgcgatcttatatgatcaatggcatgaactgcatccgcgctggaacgcgcagacgcatattatcatgaatgagaaaacgcctcctgaactgatcgaccgtatacgttacagagaaacacgtgccgaaccggccatcgtccatttctgcggcggggacaagccttggaatacaggcacctcgcacccgtatcgtgatcattatttccgatatatgtcctttacgaaatggaacacgattgaccgcccggccatgaaccaataggcaggtgtgatgaaaacgcttgtgaagccgttgaccggctcacaagcgttttttttattatttcacccgaatcgcacgcacgcgtttttgcaggctggtcttttcggcagacggcttcaatcggctgactgccgtttgcgccgctgattttgcttttttcgtcttggttttttccgccgtttttactttgtcccttgcctgctgccggttgagtttatcttttatccagccaagccgtttttccagaacggttttttcttttcccggctggatttcgctgactgctttttgggcttttgcggtgttggcctcagaagtctttttttccgcctgcttgacgctggcctcagcagttctcaaaaggcttgagttgacagcgttcagccgcttttgcagcccttttttctctgaaccggccggtaatttgcggatggcgctttgtgcggcattgacggcggtttttttcttttgtttttcggcagtccggactttgtctcttgcgtccgtcacatttcttgccgtctgaactttattgatccgcgcctcgagagcggtttttccttttgacttggacagtttgctgactgccgtttttgcttcatcgatatctgcctgctttttcgtcttttccgcttttattacggcccgttcggcaaagctcttttgttttgtgtgatattgcgccagtccgtagccgaatcggctgtcacgtccgggagcgcccagatctttgacgttctgctgcatctgctgccggagctgtgtatttgtttcctccggatatttctgcctgagcagcgcgaacatgccggtgacgtgcggcgcggcttgagatgtgccgtcagctgtggcgtacatttgattcagatacgtgctcgtaatattagtgccgggtgcggcaaactcaatttgttttccggtcgtggaaaaagctgcgagcccgtttttttcagttgacgctgagactgccgttacgctgctgtaggcgcccggataattgacgggttttttattgccgtcgtttcctgcggcggcaacgatcacgattccttttttgtaagctttgtcaacggcgtcgtgaagacttttgctgtctgcgtttgtcccgaggctcatattgatgatgtccattttattggcgatcgaccagtcgatcgctttaagaaggcttttgagatctcccgctccttttctgtctaatgctttaaccgcatataaccggacatccggcgcgatgccgtcgatgccgtatccgtcatgtttggccgcaatgattccggcgacatgcgtcccgtgtccgttgtcatctttgtatgagggagtatagctgactgcggaatagcctccggcaatggagagatcatcatgagggtaaatgccgctgtcaatgacagccactttcaccttttttcccgtcaagccttctttccacgcctgcttaacctgagtcggttcgatatcccattgcggcagcacgtaactgctgctttgggcagctgataacgggcggatatcagaaccgcctgctgcctgaaaggatacattctcttctacatataagatgtcagggtcctgtttcaggtctttcactgtttgcgaatcggctgacacggcgactgccgggagatgctgataggtctgttccacatccgctccgctgtctatggcggattccttgccgttttgatttttgtacaccacgataacgtcccggtcatgcgtctcggcgtgcgcgggcgccgcggcggagaacaggctgatgcacaaggccgcggccattatcggtttcagggtgtgatacattgcgattccccctttttctttatatatcggcagtgcggaattctttttttcctgaggggtaaggaaaatttctgtatgcaaatgtaagcgtttccaaaatatgatggagaaaatgctttaagacatctgcgcaatgaactcaaaaagggggtttttgataaatgagtacgttcaatcgggtcatggaagaaaaaatcatgcctgtcgccggaaaagtcgccggccaaaggcacttaagagctttgcgggacggcattattttgactatgccgcttatcatcatcggatcggtttttctgattctgacgagtcttccgattcccggttatgccgattttatggctggtcttttcggtgaaaattgggttgaaaagctcgggtatcccgtgaatgcgtcctttgacattatggcgcttgtcgccgcctttgggattgcttaccggcttgcggaaagctatgaggtggatgccctgtcgtcgggagccattgcccttgccgcctttttattggcgacgccgtatcagattccgtttatccctgacggctcgtcaacagagattatggtgggaggcggcataccgatttcgctgctcggaagcaaaggtctgtttgtcgcgatgatcattgcaatgctgtctacggaagtgtaccggtttattatacaaagaaatatcgtcattaagatgcctgacggagtgccgcctgcggtcagcaaatcgttcgttgcgctcatccccggtttcattattattacgcttgtatggctggcccgtctgtttattgaaataactccttttaaaagtctccacaatgtcgtaggcgatctgctgggcaccccgctgtctattttgggcgggagtctcggcggaagtcttatcgccgaattcgtgcaaatgctgctttggtcgtgcggcatacacggcgcgtccataatcggcggcgtcatgtcgccgatctggtacggggcgatggacgccaaccgtttggcttttcaggcgggagaagcgctgccgagcatttttacgacacagttctttcaaatatggattaatgtcggcggaagcggagcgacgcttgcccttgtgctgaccatgcttgtgcgctccagaagcaaacagatgaaacagctcggccgtctcggcatcgggcccgcgatttttaacattaacgaaccgattattttcgggatgccgctcgtcatgaatccgctgttaatcgtgccttttattgttgcgccgctcttgaccattacggcgacgtacatcgggatgagcacggggatggtggcaaaaccggcgggaatcgccgtgccgtggacgatgccgccgctgatttccggttatttggcgacgggcggaaaaatctccggttcggtcatgcagctgatcaatctcctgattacatttatcatttattatccgtttttccgaatttgggatcttcaaaaatggagagaggaacgggcggcggaacaaaacgtcacagaagaaacataaaaaaaaacgggcgctttcgcccgtttttttaacgctggaaaaattcgatccattcgccgtcaggtccttcaatgtaaaagtagcggtacccgttcggaagtgtcgtgatttcttcatcaatgaatacggcgccctgacgcttcgcatgcgtgaactccgctgcgatatcttcagtcaataaagcgacatggtgcacttttccttctgcgggaagctcgctgctgtagccctggatcagctcaatttctgtctccggcccttcttgaaagccgagaaaggcaagttcaataatgccgttcgtatgagtgatacgatcctttaactgcataccgagaacgtcttggtaaaaggcgatggatgtttcaatatctttgaccataatgcctgtatggtcgattcttttggctgtcatggttttccccctgttttgaatttttcgggacaatgcggtgttgatcatgttttatggtacgataagagaaagcaaaacgaaagaggaatgcacaatgaagctacttacagtgaaagatacatttgccggaaagctgaaaaaaggattccccctgattgaaaaagacgctctgtccggaagctcggctcatttaacagagggcgatctttttgatgtgacatccgagaagggtgagtttatcggaaaaggctattacggtttgcagaataaaggagtcggctgggtgctgtcccgcgcgagagatgaacggatcgacggacgtttctttctggacaagctgaaaaaagcggctgaagcaagagcccatctgtttaacgcgcccgatacgacggcgttccggcttttcaacggtgagggcgacggcatcggcggcgtcacgattgacttttatgacggttatctgctgattcaatggtacagtaaaggcatttacgcttataaggacagcatgattgaggcgattgacggactggagctttcttataaagcgatctatgaaaagaaacgattcgatactgccgggcaatacgtggaagacgacgattttgtcaaaggcgaaagaggagattttccggtcattgttcaagaaaacggcatacggtacgcggcggatttaaacgatggggcgatgacgggcattttcttagaccagcgtcatgtacgcaaagcgattcgggacaagtatgcaaacggcagacgggtgctgaatacgttctcttatacgggggcattttccgttgcggcggcgcttggcggagctgagaaaacgacaagcgtcgatgtcgccaaccgcagtctcgcaaaaacgattgaacagttcagcgccaacggaattgattatgaggcgcatgacattaaggtcatggatgttttcaaatacttcggctatgcggagaaaaaagggctggcgtttgacctcatcatccttgatccgccttctttcgcccgcacaaaaaaacggacgttcagcgcggcgaaagattataaaaacctgctgaaggaaacgatcgccatcaccgcaaaaaacggcatcatcgtcgcttcgacaaacagcagcgccttcaatatgaagaaatttaaaggttttatagagaccgcctttaaagaaacaaatgagcgttacgacattttggaagaatacacgcttccggaagatttcaaaacgattccggcgtttaaagaagggaactatttgaaggttgttttcttgcggaaaaaataggatgatcatttatagcgtggaaagagggggaaaagaaaaccctcttccatcgctttaatacgggataaataatcttcatatcttactgtttaaagaaaaaacccgctattatttagtatctcatctgtgccaagtaaagtggcctcactaatccctccgcccaattgtatcctcgataatgattttaatgggcaccaccctttttttgagtatctatataaattgtaatggcatcactcatgagcttcgccaacccttcaccataccggtcgatgttcttagtgaagcgttcatcttcaatatagagttgacctaatccgtaaaaggcatcaaaagaatattcaccaaaattttcattgagaaaatcaaaccactctttgatagctgtttgtacgtctggggactcgggagattggttaataaggagtgcaaatttattgaacattgcagtccacttatcagataaatctttttgctcaccatcagtcatgtttttcaatctaatatttaccttatcgacaggttgatcaccccaccgtttgcgggcttcttgctcataaagattatcattaaagttaattccctcaaaccgctctttgttcgtcatgcaaatctctcccatcatatgtttgattgatttatcgatggtttcaatcatcttattgactctattccgtttctcaatcaacattttcttttgtaaaatgaatgcttcccttcggttaaatgaaggattagtaatgatttctttaatctcttttaaggagaaatcgagctccttgaaaaatagtatctgctgcagctgttcaagattctcttcagaataaagccgataaccggaatcggtcgtttcctgaggagtcaataatccaatttgatcgtaatgatggagagtgcgtatgcttactccaatcaggtcagctacttcttttactttcatacccattacgtttgccgcctccttaatggctactctaaagtattacgcaacgtaagagtcaatagttggttaaaaattttttgtatataaagggagaacatatgaggatttcattgctgaaattaaagaaaaaaaagccgggcgtgaagctccggcttttttctattcaataatgtgctgcacccggccgattcgcccgtcttcaaggcggaccttaatgccgcgcgggtggaagcttgagttcgtcaaaatatccttcacgattcctcttgtcagctttcctgaacgctgatcggctttcaggacgatatcgacttcaagtccttttctgatgctgcttcgctgctggccgttcatatgacacatccgttcttcagtcttttcacttcatgtcttatcatatcgtgttttcgtctttttatgaaggacagacaaatcaattcttcatggcaactaaaaaaagaccgctctgtaaggagcagtcttttatgacataaacgaaagcaaaatcggggccgcgcacagtgtcataatcgcggcgagaatcatggacacgcttgagatcgttcctgatacggagctgagctcaaatgctttagatgttcccgctccgtgcgcgctagttccgagcagcacgccccgggcaatttcgttatcaatgcggaaatagcggatgaccatcggcccgatgatcgttcccaataaagccgttaaaatgacgaaaaccgctgtaacggccggcatcccgccgatcatttctgaaacgttcatggcaatcggcgtcgtcacggatcgcggcacgagactgtcgactaagctgctgccgagattgaaccattttgcgataaaggctgttgacagaatggcgatacatgaaccgaccgctacgttcaaaataatttccacggcgtatttctttaaaatcgggaaatatttataaagcgggatggcgaacgccactgttgccggctgaagcatatcggtcagcagtccgccgccgagattgtatgtctgatacgggacattgacaagaagcagcagtacgaccaaaacagcgggcgtaatcagaagcggcgacgtatacacccgcggaaaacgaatgtagagttttttcgcgcccaaatatactaagacagttaagaataaacttatgattccgatgaacacgtttgttttttctcctttctttttgctatcagctgtgtaagcgtacctgttgaaaccatcacgacaaatgtgctgatgacgacgacaagtaaaatgcttacgccgaatttagacataatatctccgtattcaatcactccgacggcagacgggatgaaaaacagcagcagctcaccgaggagccatgctgcgccaagctcaatccattcaagtttgataatcttgaaatgcaataatgtgaaaagaatcacaatcccgattatactgccgggaatatttatatgaagagccgccgtgatccaattgatcagacgcgcaaatataaacagcagagcgatttgaataacggtaagcagcaattttttcataatgatgcctcccttatatttatattgtacagaaggttttgctataggtaaaatacatataaagaataatgtgtattccttttgtctatagaaaggatgaaatgtaatggatatccggcacttaacgtatttcttggaagtggcccgtttgaaaagctttacgaaggcttcacagtctctgtatgtttcacagccgacaatctcaaaaatgattaaaaacctggagacggagctcggcattaaactgttttaccgcaatggccggcaagttgaactgactgacgccggacagagcatgtatgtgcaggcgcaggaaatcacaaagtcattccaaaacctgacgtcagagctgaacgatattatggaagtgaagaaagggcacgtccgcatcggtcttccgccgatgatcgggtccggctttttcccgagagtgctcggtgacttccgcgtcacataccccgatgtgacgtttcagcttgttgaggacggctctattaaagtgcagcaaggggtggaggacggctcgcttgatatcggggtcgtcgtgcttcccgcgaatgaagagatttttcataccttcacaatcgtcaaggaaacccttatgcttgtcgtccatccgtcacatcggctcgctgacgagaaagaatgcagtcttcatgaattgaaagaagagccgttcatatttttcagggaggattttgtccttcataatcgaattatgacggaatgcgtgaaagccggattcaggccgcatgtcatttatgaaacatcacagtgggactttatcagcgaaatggtatccgccaatctcggtatcggcctgctgccggaaagaatctgtcgcggtcttgatcctgacaaagtcagaaccattccgctcgttcatccggtcattccgtggcatttagccatcatttggcggaaggaccgctatatgtcctttgccgccagagcctggctggagcatacgaaatcgtatttatggaatccgaaaaagagaaaaaaggatgattaagcatggacgcacaaaccgcagctcaacacttgagtaaagtgcgggatcaaaacccgctcgttcacagtatcaccaataatgtcgtcacgaacttcaccgctaacggactgctcgcgctcggcgcatcgcccgttatggcttatgcaattgaggaggccgccgacatggcgaaaatcgccggagcgctcgtcctgaacataggcaccctcagctcggcatcggttgaagctatgatcgcagccggaaaatcggccaatgaaaacggtgttccggtcatttttgatccggtaggcgccggcgccacgccgtttcggacggcatcagcccgcaagatcatacaggaggtccgcttgtccgttattcgcggaaatgccgcggaaattgccaatattgccggcgcccctgattggaagataaaaggcgtggatgcgggggaagccggaggagatgtggttcagctcgctaagacggctgcaagcgggctgaagacggtcattgcgattaccggaaaaaccgacgtcatctccgacggcaccgacacatacgccgtacaaaacggtgataaactgctgacgaaggtgacgggggcgggatgcctgctgacgtctgtaatcggagccttctgcgcagcggggcaggacgttctgcaagcggccgtttcagccgtttctgtatacggaagcgccgctcagcttgccgctttggacacctcccataaggggccgggcagcttccagattgagcttttaaacaagctggcaagcatctcagaacaagaagcggctgagcttgccgcaattgaaagggtgatagaaaaatgacgcgtatttctcgggaaatgatgaagaatatgttatcggtttattttattatgggatcaaacaatacaagcgcagacccggtttccgtggtgaaaaaagcaattgagggcggcgctacgctttttcaatttcgggaaaaggggagcggttctttaacaggggatgaacgtgtcctgttcgcgaagcgggtgcaggatgtctgcaggcaggccgggattcctttcatcattaatgatgatgccgaattggccttgcgccttgaggcggacggagtgcatatcggacaggatgacgcagacgccgaagaaacgagagcggcaatcggcgatatgattctcggtgtgtcagcacataacgtctccgaggtgaagcgggcggaagaagccggagccgattacgtcggaatgggcccggtctatccgaccgaaacaaaaaaagatgctgaagccgtgcagggagttacattgattgaagaggtacggcgtcagggcatcaccattccgattgtaggaatcggcggcattacggctgacaacgcggcgcccgtcattgaagcgggtgcagacggcgtcagcatgatcagtgccatcagccaagccgaagatccaaaagcggcggcgcggaagttttcagaggaaattcggcgctccaaagcagggctgtcccgatagggcggccctttttctgtgtgcgcaaaaaggcgtgacggactgggagaatagaagccgtatgtcaagaacagagcaatcaagcttgcaatatcgaccgaagcgtttgacggctctatcgcttctctcaaagtgacgcctgaaccaatcagcgcaggctcaaaagccctctataaaacagtgaatagcgcgaagtgagagaccatttcgaggtcacggaaaaacttaatgcggaattcagcgaatttgaagttttgatgtcgaaatacaaaacgtgcgatcaatgtatacgtcttgtgatacattaagtacagatcaaatcagagagataagcacgaagctgacggccctttctgaaaccatgtcgaagattgccgatgtgctttaaaaggagttaagacacagcatgagcgatgaacataacaaggaaaaacagatccacagacgggatgtcctgaagtggggcgccgtcgcgggcgcagccgtcgctgtcggagcgagcggcctcggaggactcgcgccgctcttcaaaccggcggccaccgcttcaaagaagaatgatgaaaaacgtgatcgtgatcaaatcgttcctttttacggaaagcaccaagcaggaatcacaacggcgcatcagacgtatgtgtattttgcggcgcttgatgtcatgtcaagcgacaaagccgatgtcatctcccttttcaaacaatggacaagcttgacgcagctgctgacttcaggcgccgtcccgtcaggcgaacagaaaaataaatatatgcctccgcaggataccggggagtcgcaggatctggcaccggcgaatttgaccgttaccttcggcttcggccccgggtttttcgagaaagacgggaaggaccgcttcggactgaaagataaaaaaccgaagcacctcgccgatattccgccgatgcctaacgacaagctcgataagaaacaaggcggcggtgatatcgtcatacaggtctgcgcggataatgaacaaacggcgtttcacgcggtgcgcaacctgatgaaacaggcatcgggtgtgtgtgaagtccgctttctcaataaaggtttcttaagcggcggaaaaaacggagaaacaccgcgcaacctcttcggattcaaagacggcaccggcaaccaaagcacgaaggatgaaaacctgatgaattcgatcgtttgggttcaatcaggagagccggactggatgacgggcggcacgtacatggcgtttaggaaaattaagatgtttttagatatatgggaccgttcatccttgaaggaacaagaggacacgttcgggcgggtgaaaagctcgggcgcgcctttcggacaaaaaaaggaaaccgatcccgtgaagctgaatcaaattcccgccgactcgcatgtcagcgtggcaaaatcaaccggcagacagattctgcgccgggcattttcctatacggacggaattgatccgaagacgggctatgttgacgcaggcctgttgtttatctgctttcaaaaagacccggaccgccaatttgtcccgatgctgaaggctttggcggcaaaggatgcgctgaatgaatacacacaaacgatcggctcttccttattcgcctgtcccggcggctgtaaaaaaggagaatatatcgcccaaaggctgctggaatcgtgacaccttccatatggagggtgttttttttaaaaaaaacacttgtaactataaaagttacaacttaaaatgataaggaaaggagacttacaatgacactgcagattaaagtatattctgattatgtatgtccgttttgctatgtcggcaaagcggcgtttgaagaagcaatcaaggacaaggacgtacaggtggaatggatgccgtttgaattgcgtccgagcccctcgccgaaacttgatccggtgaatgatcccgccaagcggcagatgtggaaaaactccattgagccgatggcgcagtcgttaggcgttgaaatcacgttcccccgcgtgtcaccgcatccatacacggatttggcatttgaaggctttcatttcgcaaaggaacacgggaaaggaagcgaataccatacacgcgtttttcaggcgttctttcaggaagaacaaaatatcggtgacgttggcgtgctgacaaagcttgcggaagaagccggacttgacggcgctgccttcaaagaggcgcttgagacaagagcgtacaaggacgtacagcgggaagcgctccgccatgcttatgaggaagccggcattacggcagtgccgacgtttatcatcggcgatgagagaatccctggcgcggcgggaaaggaaacctttgaacaaatcattgagcgggaactgaataaacgttaacccgaaaaaagccctctcgatcagcgagagggctttgccatatagtgtttgacaaatgtttgtctgtccgcttcatatgccgcggcgtcaaaggagtcgccgcaaaaatgaaggcaccaagggtctttctggcaggcgacgccgacttgatagccgtgtttttgaaattcgagcgactgtgatgtgtcgtaaaaatgaaagccgcgaaacaaatcctcccgccactccacgtcatattgagccgccattaacaagccgtcaatggcgtcagcgggcgtaaacaggccgtcttcatcaccgtgctcaaaatccagcgggtgataagcattcccccggtattcaatcacttttcccatccgctgtccgctttcccaccaaatgccgttcggcggcagggttttgcagccggcgacaccgagaaggccgagctcctgatgagattgaaagatatgaagcatgtcatgaaggaaatgctgatgaatgataaaagtatcctgatgcagataaattttatatttggaggggtgtttcagcgctttgttgtaggacgaggccatgcttgctgaatcgtatatcggcatgatatcaacggagtatgaaggggggacggtaagctgcatgatatggctcttgcaccgggagtacagcgactcatcattcacacagacgacaaacagaaatgaatgtgaatccattacatgctcctctcggcctcaatcacatattgataggccgatgcttctgtcataaagtcatgccttatgccaagctgtacgcatacttcgtgcaatgatgcgatggctttgtggtaagaagggtgatcaacgcggatcgcctcaatgcgtttgacctcatagctggcggctttaaataatgaaagagtctcttcccgggtaaaaaaacgcaggtgggtctgatccattaatccggcgtcactgtaagtccatttgccggctaaaagctccaacacgactgagatgtggccgacattcggtatgcatgcaagcacagtgccgtctttttttacataaggacgaagctttttcagcactgtccacgggtcgacaagatgctcaagaacgtctccgaacagcatgcagtcgaattgctctgattcgtacggaagaatggcggattcaatgtcgccgcaaagcacgtggctcaatttgctttccgccttttttgcggcttcgggatacgcttcaatgccgtaaaccgttattccgcggtcttcgatcgccgctcctaaattgcccgtgccgcagccgacatcaagcactgtccgccagttttcgtctattttgttcaataaataaggattcaggccttcgtagtagttctgttgtttttcatcataatagggattcgtatccatctgtgtatcacctcataaatgggcataatacacaagatatgcagcggggggatctcatatcaccatgtttggctgttcaattgcggaatgcggacgggaatggttgtccggtatacggtttgttctctgattcccctcttattgcgggtgttcctttgaaaactcgggtgcgggcggactgtggcaggtcatatagtaaaaggatccgcctgtaatcttaccgctggcggatggtgtttttcattggtgtttttttcttcaccgctttttcagtatttaagaagcgcctcacatcgtcaatgtgcaaacccatgattctagcctcttgaattaacaattgccaatcttgatctatatctttcattacatgagttttcataagaacctccaattgaaaaattgatttgcccagctacagcagccaatgtataacaaatatcacacatagttggccggtaatcccaaattgaagatgaattcacctacctattccctaagaaaatgactgaaataaccaaaatccttcaagaattcttacatataataataaacaaataaatactgactggatagtatgcaaataaaaataaaccatatgacctattaacatttaccctcaaaacgtcgattagcatattctttttgcataaaaaataccgcaaaagaatgattcggtgtaagataaagtgaatgatcaaacagctggggtaaaaaatgaaaaaaaacaaatttcaaattaagagagaagaaacatttgaaagttttattgacgcaggccttcatctcctgattgaaagagcttacgattcagtctcaatcgatgacatcagtaaagcggcgggtttcagcaaaggggcgttttacgttcattttgaaagcaaggaagattttctgaagcatttgttagagaggcgtcagattaaaaaaaggatcatcactggctatctcgacgaattagaaaagcaaacagagcggccgttgacgctttgtgaagccgcggccagcgcggccagcctgttgatgcggtttgtaaacagcaagcctgcctggaatgttgtgtcttttgccgttcatatgcctacttacaaagtcgtcagtgaatatgaagcttatatccgcctgtataagttatggatagaagaaagcaccatgtacataaattggctcaaatcgagaaatttaatagaagaccatatagataccgagcataccgctaacatgatgtgcgcgctcatcgacggggtgattaagcaatccaatgtgctgggaaggccggttactttccgcagcatgtttgacgcgctctatgtttttgtcagcaccagaaaatcagggtaacgttcttcttgatttgacaaaaggtttagaaaagtctttcagaaagcgaggaactgccatgcgctacagagaaattatgatgtatatcattatggggatattcacgaccatcgtgaatatcgtcagtttttacattctgacgtcggcatttgagatggattacaaggcggcgactgtcgccgcttggattctgtccgttctatttgcttatgttacgaataaacggtatgtctttcagcaaaagaccgcggggatgcggagtctgatgaaagaattaacggcctttttcagcgtgcgggtactgtctctcgccatcgatctcgccatgatgattcttctggtcagtcaatttcatatgaacgaaacattggcgaaaatcgccgataacgtcattattgtagtcgtcaactatgcggccagcaagtggattgtcttcagaaaagcgaaagaagagggcgtgtcataaccgtttctttccgcgtcccggggggaaagtgtaatggtggaaggggatgcgtttgaagcgcaaaataaagaaagcgtttgctgatgtattcggggaatccgagacctgcgctttttctttgcgcccggcagagtgaatctcatcggagagctaacgggggccgctatgaggagaagacagagagaaaagctgacttttacacggcggatatcggcgccggagcgagagaactaaagggggatgacgatggcaattgagcggcacgtggaacgtttaatccagtacggattgcaaaaagagctgatttcatttcttgatattgaatatacaagaaaccgtttatatgaaactttgcatattacccatccggaggcttcagaacagaaagaaaatgaatcggcggcatcattgccggacatattggccccgatttatgaatgggcggcagaaacgggccggattgcagccgatacagacacctatcgcgacctgctgagcgcgaagatcatgggctgctttgccccgcagccgtccgagattgtgcgtcgttttgaagaaacaaaggcggtgcacgggccggagcaggcgacaaaggcgttttaccgattttcagaggatgtgtattatatccgttcggacagaatacagcggaatgtcggatggacggctgagacggcttacggaaagctggacatcacgatcaacctttcaaaaccggaaaaagatccgaaagcaattgccgctgccaaagagcagcctcaatccgattatccgggatgtgttctttgtaaagaaaatgtcgggtacgaggggagaccggatcacccggcgcgtcaaaaccttcgtgtcattccggtcattctcggcgatgagcagtggtttctgcaattttctccgtatgtgtattaccgggagcattgcatcgttttgaaagaccggcacgaaccgatgaagatcagcaaaaaaacgtttgaccggctgctgtcgttcgtcagccagtatcctcattattttctcggttccaatgctgatctgccgatcgtcggcggcagtattttaagccacgaccattttcaggggggccattatgaattcccgatggcgctggcggagacagaaagctggtacaggctgcctgactatccgaaaacggtgctgggaattgtgaagtggccgatgtcggtcatccgcctgcagagtgagtgcgcgtctgagctttccggcgcggcggatgccatcctgcgggcatggcgcggttattccgatgaggcggctgatctcctcgcctgttcaggagaaacaccgcacaatacaattacgccgattgcccggcggagaaacggtttattcgaattagatctcgtcctcagaaataaccgcacctctgatgagcatccgctgggaatttttcatccccatcaggaagttcatcacctgaaaaaagaaaatatcggactgattgaggtaatggggcttgcgattctgccgggccgccttgaacaagaaatgaaatacacggctgaagcgctgtgctcaccggacccggaggcggtcttaacggcagacccttctgcggcaaagcataaagattgggcgctcagtgtgctgcataagcggaaggtaacgaaagaaaacgcggaacagattctgaaagaggaaatcggccatgcctttgcgcggatactggagcatgccggcgtctttaaacagacagaagaaggcagagcggctttccggcggtttatccgccatttgggcgctctaccggaaaaaagccccatcccataagggacgaggcttttttttatcctctgcttctggcgatcaggctgaataagaataccacgatcgcagctccgatgattgccggaatgatggcaaagccggcaaggtgaggcccccatgtgccgagcagtccgtgcccgatccatgcgccgatcagaccggcgatcattgacccgatgattcccccgggcatactgccttttacaaataaacttccgatccagccgataataatagcgacaatcagagatacgataaaacccataaatatcacttcctattttttattatttatgcctatatgtttccttcgttttgtccatattaaacatatgaatgcgttttttataatgaacatatcaaggcgcgttccggtcttttttttcacaatgcgttgcgttaaaatggaaaccgtgtgaaaaggtgtgagcaaaggaaaaaatatttcttttgtagaatgtttaacaaaatgaaactttttgttgaccagcgatttttattatggtaaacctttatttggtattattcgttctcgctatcttttttctctatatatgctaaatgatctaaaactttttatgtttgatttacgcaagtggaaaaagctcatgcattttttgacgattttgtgacattaggtcgaaaaaaagatgaactttagaaaaaaataaagctaataagggcagattttgatagcataacaaggtagatagagaaaagattttgagaaagtacatttcagattcactacatcaataggaaggatggtgatcttcttgttcagagcatttaaaccgttacttttattagcgatgttggctgttgttttcgtactgggcggatgcagcgacatttccgttttagatccgaaaggacctgtagcagaccagcagaaagatctgattctcttgtcaatcggatttatgctgttcattgtcggcgtcgtattcgtactatttacaatcattttagtgaaataccgcgaccgcaaaggcaaagacagcggaaattacaagcccgagatgcacggcaacacgttcttagaagtagtctggacagtgatcccaattttaattgttattgcactttctgtgcctaccgtacagacgatatattcgttagaaaaagcgcctgaagcgacaaaggataaagagcctcttgttgtttatgctacttcggtagactggaaatgggtattcagctaccctgagcaggatattgagacggttaactacctgaacattcctgtagaccgtccggttttatttaaaatttcttcagcagattcaatggcatcgctatggattcctcagcttgggggacaaaaatacgcgatggcgggaatgctgatggatcaatacttacaggctgacaaagtgggaacatatgaaggccgcaacgcgaacttcaccggcgaacactttgccgaccagaaattcaacgtaaaagctgttacgcaaaaagactttaacagctgggtgaaaaaagcccaaagcgattctccaaagctgacgaaagagaagtatgacgaactgatgcttccggagaatgtcggaaaattaacgttctcttctacacacttaaaatacgttgaccacggccaagatgccgaatatgcgatggaggcgcgcaaacgccttggctacaaagccgtatcaccgcactctaaaacagacccgtgggaagatgtaaagaaaaacgaatttaaagtatccgacgataaacaagattgaaattgaacaagaaaggaggaagcccgaatgaaattgagatgggatgaattttttgtaacaggtgacccattaattctgggcgcacaagtttccattgcgctttccactatcgctatcatcgttgtactcacatacttcaaaaagtggaaatggctctggtctgaatggctgacgtctgtagaccataagaaacttggaatcatgtacattatctctgctgttatcatgctgttccgcggcggggtcgacggcttgatgatgcgcgcccagttagcgcttcctaataacagttttttagactcaaaccactataatgagatctttacgactcacggtacgatcatgattatcttcatggcgatgccgtttttaatcggtctgatcaacgttgtcgtacctttgcagatcggtgcgcgcgacgtagcattcccttacttgaacaacctgagtttctggacgttcttcgtaggtgcgatgcttttcaatatttctttcgttatcggaggttctccgaacgcaggatggacgagttacatgccgctggcaagcaacgacatgagtcccgggcctggtgagaacttctacctgctcggtcttcagattgccggtatcggtacgctgatgacgggtatcaactttatggtgacgatcctgaaaatgcgtacaaaaggcatgacgctgatgcgtatgccgatgttcacatggacgacgctgattacaatggttattatcgtattcgccttccctgttttgacagtggcattggcgctgttatcatttgaccgtttgttcggcgctcactttttcacgctggaagccggcggtatgccgatgctttgggctaacttgttctggatttggggacaccctgaagtatatatcgttatcttaccggcattcggtattttctctgaaattatttcagcgtttgcaagaaagcagttattcggttacaaagcgatggtcggctcaattatcgccatttccgtcctgagtttccttgtatggactcaccacttcttcacaatggggaacagtgcgtccgttaactctttcttctcgattacaacgatggcgatttcggttccgaccggggttaaaatctttaactggctctttacgatgtataaaggccggatcagttttacaacaccgatgctgtgggcgcttgcgttcatcccgaacttcgttgtcggcggggtaacaggggttatgcttgcgatggctgcagcggattatcaataccataatacgtacttcctcgtatctcacttccactatgtgctgatcgcgggtacggtatttgcatgtttcgcaggatttattttctggtatccgaaaatgttcggccacaagctgaacgaaagaatcggaaaatggttcttctggatctttatgatcggatttaatgtatgtttcttccctcaatacttcttggggctgcaaggtatgcctcgccgtatttacacttacggaccgaatgacggatggactgcattgaactttatttcaactgtcggagccttcatgatgggtgtcggattcttaatcctttgctacaacatctactacagcttccgctactctactcgcgagatcagcggagattcatggggcgtgggacgtacgcttgagtgggcgacttcatctgcgattccgccgcattacaactttgcggtgcttccagaagtgaaatctcaagatgcgtacctgcaattgaaagaagacaaaacggatattcatccggaaagcaagttcaagaaaatccatatgccgcacaactccggaagaccgcttattatgtcagtggcgttcggtattgctggcttcggacttgtatttgaatggttctggatgggcattgtcggcttgatcggcattctgctttgcatggtgcttcgttcatttgaatatgacaatggctactatatacctgttgaagaaataaaagagacggaaagaaagatttccgaataaaggaggcgtgatttatggaacatgcagaacacggcaattctaacgcgcctatggaatatcaatctgaaaccggcagactcaatattctcgggttttggatctttttaggggcagagattgtgttgttctcaacactatttgcaaccttcttcgttcttcaaagaagaacagcaggaggagtcttaccggctgaattatttgaagtgaagcttgtcatgatcatgacattcctgcttctgatcagcagtttcacctgcgggatcgctgttcatgaaatgcgtcgcggaagtttaaaaggcgtcgtcatttggacgatcattacgcttcttctcggtgcgggcttcgtcggatgtgagcttaacgagttcatccactatgtacatgaaggagcatctctcggtacaagtgctttctggtctggattcttcgtccttctgggaacgcacggaacgcacgtaacgatcggtatcttctggattgccggcatcttactgcaattgaagaaacgcggattaacgccgcagacgtcttcaaaaatctttatctcaagtttatactggcacttcttagacgttgtttggatcttcatctttacaggcgtctatctcatcggattggggggactataatatggcaaacaaatctgctgaacacagccactttccgtggaagcatatcgtaggttttgcgttgtctattattctgaccctgctggccctttgggttgcggtatatacggatttaagctcatcagcaaaactgtggatcattttcggattcgcatttatccaagccggtcttcagcttctcatgttcatgcacatgacagaaagcgaaaacggcgggattcaagtcggaaacacgctcttcggatttttcggagcgattgttatcatccttggttccatctggatctttgcggcgcactaccatcacggtgaccatatggatggaaaccctcctggcggtgcgaagcaacattccgaacatcaggaataaaaagaaaccctcttcgttcaggcgaagagggttttttgtgcctttattggcttcttctccggcgcaggcgcggaaggccgtaaatgataaaggcggcgatatgggcaacgatgacgttgacggcaaacaggatgatcatgagtgtgtggccgagaggggacaggctgctggttgcgtaaaagtagaagaaaacccacatgagaataattggcggtatggccgaaagagcgacttttttgttatccagccagataaagaggggtgttgcgcttgcgaccagtaaataagcaaaaaacatgtccatcttacatgtctcctttcattttatgggagcgtttccaaaatgaaatacagagaataaaatgtgtctgttttgtggtcgttttttgaacattttgttacaattattataccatgttttccaatttttgataccgctttatcgagaaatgtattgcaactattgcctcatttttggataggtacaagaaaccggaaaggtcaaataccctgtcacatttccggacaagggaatggcgcaggctgtgaacctttgctatgttcaaagaaaacatgcacagcgagggtggttttgaagtggacataacaaaagacgatgtcacagcgccggacgtcattgcgcttttgcaggagcatctgaagagcatgaccatgcattctcccccggaaagtatacacgcgctcaatgcggaccggctgcgtcagcctgacgttacgttttggagtgcgagggaaaacggcgtcctgctcggctgcggcgccttaatggagctaaacagccggcacggtgagatcaaatcaatgaaaacggctccgcatcatgtcagaaaaggcgcagccaaccggatcctccgccatatgcttgaagaagcaaggcggcggggctatcagcggatcagcttagaaaccggttctatggaggcttttctccccgccagacgcctgtatgaaaaagcagggtttcaatattgtgatccgtttgcacattataaagaggacccgaacagcttgtttatgacgttaaacatagactgaaaccccttttctgacgagaaggggttttttatcggaaaagtttcatcatgaccgaaacatttccttttctgacacgtcatatgtcgtgtagtccccaaaccgtaaaaaataaaaaggaagcaacctcatcatgttttcttgaacggtgttcatgtataataaacaatagtgacttccgatgaaaatgtaaggcgggatagaatgagtcgatataagaaacagcaaaatccctattatcagggggatttgatttttatatttggtgtgtttttaataattagtgttgcggcgatttatgcggccggacagttcgggcagtatggaggcagtgcctggatgaaacagattgtcttctatgttataggtgcgggattcatcggattattgctgtactttgatttagagcagcttgagaaactgagtctgtatgtattgattgccggcgtgctgtcgctgctccttttgcgtgtggcgccggaatccatcgcgccgatcaaaaacggagcgaagagctggtttcaaatcggcaactttaccctccagccctctgagtttacgaaaataggaattatgatgatggtcgcgtccattatatcgaaggcgggcccgaaagatcaaagatcacttcgggaagatgtcaatctgcttttgaaaattgcggcatggacggttattccaattgggatgatcgttttgcaggatgccggaacgggtgcgatctgtctgtttatcgttatggtgatggtgtttatgtcaggtgtaaactggaagctgatcaccatcatcggcggttcggccgcgcttgtgcttggcctattcttagtgcttgtaattgaatttccccatgtggcgaattcgatcggtattgcggattatcaaattaaccggattacatcgtggatgtctgactccagtgcggcaacgactcaggccgagagcgataaaagctggcaggtggatcaggccgttatggcgatcggatcgggcggcattaccggaaacggcgttcataatctgaaagtgtacgtacctgagggacagaccgactttatctttgcgattttgggtgaaagttttggatttttaggctgcgccattgcggttgtcatgtttttctttttaatttacaggcttgtggtgctgattgaccgcttgcatgcgtttaaccgatttggtgcgtttttttgcgtaggatttactgcacttatcgtgattcacaccttccagaacatcgggatgaatatcggcattatgccggttaccggtattccgctgctgtttgtcagctatggggggagctcggtgctttctacattaatcagcttcgggatcgtatataacgcaagtgtgcagctgacgaaatataaaagctacttgttcaattcttaatgtgagacggctcgtttttcgggctgtctttttttgtttagagcatttcgcttttggcatgatactctttcggatatgatatatagagaaggaggctttatatatgaacaataccatcgaaaccatacttaatcatcggtcgatccgatcatttactgacgagcttctgacagcagaagagatagatacattagtgaaaagcgcccaggcggcgtcaacgtccagttacgtgcaggcttactccatcatcggcgtaaccgataaggagaaaaagcggaagctggcggcactggccggaaaccagccttacgtcgaaaataacgggcacttgtttgtgttttgcgctgatttgtaccgccataaaaaacttgctgaggaaaaaggagaaaacattaccgagcttcttgagaatacggaaatgtttatggtcagcatcattgatgccgcacttgccgcacaaaacgtaagtgttgccgcggaatcaatgggactcggcatttgttatatcggaggcattcgaaatgaacttgatcaggtgacagaagtgcttggtacacctgaccatgtgctgccgctgttcggcttggtagtcggtcatcccgctcatccgtccggtcaaaagccgcgcctgccgaaacaagccgtatatcatgaaaacacgtacgatacgaatgaagaaaacttccgcagttatatgaaggaatatgatgaaaccatttccgattattatgataaacggacaaacggcaagcgggttgaaacgtggtctgatcaaatcctgcagttcatgaaacaaaaaccgagaacctatttaaatcaatatgtaaaagataaaggttttcaaaagaattaagaaaaaacctctcctgaccgggagaggtttttttatgtttcacgtgtaacatatttcgacaaaatggaacaaggtatataaatgtttatcatcagggatgctgataagcatacagaaagaaaaaacggcttagcagtggtacgatgttgatgaggtgacagtgatgatttcattaagtatattggatcaatctcctgtatcagaagggtgttctgcggaaagtgcactgcggaatacagtaagattggcgcaggaggcggaaaagctcggatataagaggttttgggtgtcagagcatcatttttcagagcggttggcgggctcaagccctgaagtgctgatcagccatattgcggcgaaaacgaatgacattcgggtaggatcaggcggtgtgatgcttccgcattacagcgcatataaagtggcggagaatttccgcgtgctcgaagggttgacgccgggcagaatcgatctcggattagggagagcgccgggcggaatgccgatcgcatcatgggcgctgaatgacggcgggaagcgtaatgctgatcaatatccgcagcagcttcgtgagctggcgatgtatttgcatgatgcagctgatgacaatcaccgttttccgaatctgaccgcatcaccccttattaagacggcgccggaagtctggcttctcggttcttcgggagaaagcgcgtttctgagcgcagaaatgggagcaggctatatgtttgcccattttattaatggagaaggcggagaaagcacgacagcacaatataagcgcagatttaaaccttctgcattaggtaaagaaccaaaaacggccgtggcggtgtttgtgctgtgcgcggatacggaggagaaagcggaggaactcgcggctgtcatggattatacgctgcttgcgggtgaacaggggattccgcttcacggcgtaccgtcttacgaaaccgtccgcggcaatacgtatacaccgtatgaacaaagacgaattgccgataatcggaatcggatgatcatcggaacgaagcagcaagtgaaagaacagattctggctctcagtaaagcatacggaacagaagaagtgatggctgtaaccattactcatcattttgaagataaacttcagtcataccgtctgcttcgagaagcttttgccgattaatcagaaagaaaccctgctgatgctccagcagggttgttcggttattcaatgataaaaggtttttcagtcagcacctggcttgatttccctttgttcgcggcataggccagcatataatattctcctgccggcagtgcggtgtcaccattgactttgccgttccagtcgaaatattgatagcctttatcctgctttttgtagatgccggcttggccgacaaagtcaagattactgtcatatacaaggaaggcaagctcttcggctccagccggaagataggtttcaatttggtaggttccctgcgttgtgccgtcctgtacgtcgattgacgttacgcgcggatagtccggctcttttacaatcagcagcgtcggcacttttgcgactgtttttccgccttcacgcactgtgacggttccctcataggtgcctgcctttacttttttggcattgacctttactttcgcattgacctttccggtttgatgagcggggatcacgacccggtctgtgcccgaaacggtaatgcccgtgccgttgaaagagtactcgagctgatatgattttctgatggacgattggttttcaatcgtaaaggtttcttttttcgtttcattgcctttgtctttcataaacgttccgtaagaataacttcccggggcgacaagggagtctgctttgatcgccttcatgattctgatgcttccggcgccttgcgcattatgcgggtatacgtcaccgtccgcgtccgttaaggtttccgccgtgttcataagagcggcttttatttgttccgggctccatttcggtttggcctgcttgatgacggcagctgcgccggctacatgcggggaagccatgctcgttccctgcttcgatccgtagccgtacgggtcggccggatcatgggtcggaatggtgctgacgatgtttacgccgggagcggagacgtcaggtttaatcatccacgtgtccataaccggaccgcgtgacgaaaagtctgccatttgttcagtgagcgatttagccacggataaatggaatgtcgcttttgtgccgcccgcttttaattggctgacgagtttttcgccgtcttctgatgaaagcttaaccgtcggcacggacatgcccggtacgttggcttcaatttctcccggggcattgttatacacaaccataccgatcgcgcccgcttttttggcgttgtctgctttatccacaaaggcgatgctgccccgtttgacgaccgcgacttttcctttcagatctttgccttcaaaatccttttgctcgccgatacccgcctctatgagctctgtttcttttttattcagtgcttttatgtcatcttctttgttgtaccccattactttcgctgaggaataggaaccgaaggagacggcgtactcgttcagcggcagctgtgtcgctccgacggagatagcttctctggacgctcccggagagccgacggtccaattgttcggcccgctgtttccgtttgatgtaacggccgtgacgccttctgacatcgcccagtcaagcgccgtgcttgtcgcccagtctgggttattcacagaattgccgagagaaaggttcatgacatccgctccgtcctgtacggcgcgttcaataccggcgatgacgttctccgttgttccgcttccgcccggaccgagcacacggtaggcaaggagtgtagcatccggcgctacgcctttaatcgttccgtttgccgctaccgtgcccgcgacatgggttccgtggtcagtcgacgcgcctctcggatcaccggacggcgtttcttcaggatcgtaatcgttatccacaaaatcgtatcctttatattgtccgaaatttttctttaagtcagggtgtttatattcgacaccggtgtcaataatggcaaccttgacgcctttccccgtatagccgagcttccacgcgtcatttgcccctatataaggcgcgctgtcatccatctgcggagacacggcatccttagatagggtgatgtctttatctttcagttgatcggtatgataggtgacgttcggataaaccgctttgacatcctgatcactcagcagtttcggaatttcatttgccgggagtttcatggagaagccggaaaacacttgctcatattccctgttgatttttccgtgtttaatggttttgagcgctttctttttcacttttgagcgttcgcttttcagcttgctttttgtctgtgctttgccgagttcctttgcttccgccagtgacttttccttcagctcgacgatgactgtcgtttgtttgccggtggtcatatcaatgtcaccaaatacctcagccttctcaagatcaggagtttgcggttttgaagccggcgcagcctgtgaacttgtggataaggtaaaggataagacaaaagccggaagcagataacggatgattccttttttcaatcgtgtttccccctttttctttatctaaattagaaatctagtatatatttcttgaaaattcaaaataatccttgtgacatatgactcatttatggaaattggtctgtgaataaggagggagttatacacagaatcctgtgcataactgaataaaattgtgtatatatattgttgggaacgagtgttcccatacaaaatatagatcgagtttgtggatatgtggatataccctgtgtttaagctgtgcttaaccaagggataaggtgtgtataactttttttatcggcttttccatttttcaggtcatttccatcagctttcaacaaaacttctgaaaactagtttgttttttcactcatattgtgacaaacaattcgcccggccgcgtctatcatagagtcatagggttgctagacccgctagtttttagcggagaaggatcggccgccttttccgttaaagcggagagaaaaacaggcctgcgaacaagctgtctgtcaaaaagaagcggagggatgatttgcaatgaaacgtttgctagtatctttacgggtgtggatggtctttctgatgaactggatggcgccgggtaacggaagatatccattagccgccgtgtacggaaaccaagcggcttatcataagaaagcgaagcggacggctggtgctttttcgtttgtgagccgagtccgatcggcggatttgaccgatgaaacgaaatcggcccgcggcaggctggataaaaaccgatggatgcctgtccgcaaagaattgccgaaacgggagcgcgcgggtccggcacctttacatcatatgaaaaagagggtacaatcccactaaacatatgaacgggagcgaacctcttgagaatagacaaagtattaaataacaatgcggcgttaataaaagaagacggacgggaaaagatcgtaatgggtcccggaatcgcttttcaaaagagaaaaaatgatgtgattcaaaaacataaaattgaaaaaatatttgtcgtgcacgacgaaaatgaaaagttcaaacaagtgttagaaacgcttcccgaagagcatatagaggcggctgaagatatcatcagccatgcggagggagagcttgcggcgcctttgaacgatcacatccacattgcgctggcggaccatttatcctttgcgatcgaaaggattcaaaacggccttcaggtgcacaaccgattgcttcatgaaattaaggcgctttataaaaaagaatatgaaatcggccgctgggcggttgaacacgtgaaacaaaccctcggtatatcattgcctgatgatgaggcggggtatatcgcgcttcatatccacactgccaaggcggatgccaaaagcatgtattcggcgatgaagcatacaaccatgatcaaagaaatgatcgaaaagatcgaatcctttttcgaacagaaggtggatgaagacagtatttcctatcagcgcctcgtcacgcacttacggtatgcggtcagccggttggactcaaatgaagcactccattccatggacgaggagatgctttatttcatccaaaaaaagtatccgtttgcttatcggtgtgcgcttgaactggcggcgtttttaaaaaatgaatatgatttggaactgccggaatccgaggccggctatattacgctgcatgtccagcgtctgcaaaaaaacccggaataacgcgtctgtttcgagaaacagactttttttttgaaaacatattgacgaaagcgctatcatgaaataaaatgaaagcgcattaaaaaactgaatcggcgggattgtgactggtaatgcaggcaagacctaaaatttgcgtacatgaaaaagggatcatgctgacctttttcgttggcgaattttaggtcttttttgattttagaaagggggatacatcatgaattatcaagaaacggcaaaacagcttatcaaacatatcggagggaaatcaaatatcatcagcgcgacacattgcgccacacggctcaggctcgtcattcaagatgaacagaagatcagccaggccgatattgaagagacagaaggagtaaaaggggctttcagcagctcggggcaatatcagattatattcggtaccggccttgtgaataaagtgtatgacgctttttcaaaagaagccgatttggggcgggaggatcgtgagacacatcaggacgcggcgaaaaaaaagctgaatccggccgcaagatttgcgaaaacactgtctaacatattcgttcccatcattccggctatcgtggcaagcggacttttaatggggctgctcggtatgatgaaggctttccactgggtgtctgaacaatcatcgctgtttaagcttttagacatgttttcaagcgcggcgtttatcttcctgcccgtattcatcgggttcagtgcggcgaaggaatttggcggcaatgcctatctcggtgccgtgctcggggggattatgatccatccggcgcttttgaatccgtgggggcttgcggatgcatcgcctgattttatgcaactcttcggcttcgacattgcgctgctcggctatcaagggacggtcatccccgtactgttagccgtttacattatgagcaaagtggaaaagggcacgagaaaaatggtgcctcacgcattcgacttattggtcaccccgtttgtcacggtgattgtcacaggatttatcacctttatcgcaatcggtccgcttggcagggcgatcggatcgggcattaccgtctcgctgacatatgtgtatgatcacgcgggcattgttgccggacttcttttcggcggtctttatccgcttattgtgctcaccggtgtgcatcacagctttcatgcgattgaggccggcctcatcgctgatttgggcagaaactatatccttcctatctggtcgatggcgaatgtcgctcagggcgcggcgggactggctgtatttttcctgacgaaaaaagcgaaaatgaaagaaatcgctctgcctgccgcattttccgcttttctcggcgtaaccgaaccagttattttcggtgtgaacctaaggtaccggaagccgtttatcgcgggaatgatcggcggagcgctgggaggggcctatgtcgtggtgaccggcgtcgccgccaatgcttacggtctgaccggaattccgatgattgccatcacggctccgctcggtttaggaaatcttataaactatctgatcggaatgggcatcgcctctgtctcggcgtttattgccgcttacattatgggagctaaagaaaaggaggccgtcaaatgaggacaccggatcaagagctgcgcctgcaggctgaggaagcgaaaaagaagcggcaagaaacagccgcgtcagatccataccgccagaactatcatgttatgccgccggtcgggcttttaaatgatccgaacggcgtcatccaatggaacggcgtatatcacttgttttttcaatggcagccatttcatacggggcacggcgcgaaattttgggcgcatgtgacgacgaaagatttcgttgagtggaaagaggaagaaatcgcgcttgcgccgggtgagtggtatgacaaaaacggctgttattccggaagcgccatcgaaaaagacgggcggctctgcctgatgtacacaggcaatgtccgtgacggagaaggaaatcgggaaacgtatcaatgcctcgccgtatccgaagacgggatcgtatttgaaaaaaaaggaatcgtcgtgcgtctcccaaaaggctataccgctcatttccgtgatccgaaggtttggaagaaagacggagcgtattacatggtgctcggcgcgcagacagaaaagctcaccggaagcgctgtattgttcacatcagagaacctgacggattggacgtttctcggttcgattgcgggggcggactcgggcggtctcgggtcattcggctatatgtgggaatgtcccgacctgttttctcttgacggaaccgacgtgctgctcgtatgtccgcaggggcttgaagccgacgggataaaatatcataacagccaccaggcgggctatttcctcggcaggctgcatacagagccgccagaatttaagcacggtgaatttacggagcttgacagaggatttgatttttatgcggcgcagacgctggaagatgataagggacggaggattctgttcgcgtggatgggcgttccggatcagcatgaggacaagcatccgacacatgcgtatcactggattcactgcttaacgatgccgagacagctgtcactgtccaacggcagaatcatacagcgcccgctcccggaaatgaaatcgcgccgcacggatgaacaaaagcgccgtcttcaattgaattgctcgtctgtaagcctcccggtgaaagatgcgtcccgggctgaagtgctgctggaagacattacttgcgaatccggttttgaaatctcaattcggggcgcggcccggtttatatttcatcaggaagaggggctggctgtgctggagcgcaccgctttcagcggagaagaaaaagaaaagagaagctgcgccatcagcgagctgcattccgtccagctctttctggatgcatcctccattgaattgtttttgaatgatggagaagaggtattcagcgccagatattttcctttcccgggaaatgatgacgtaaccgtcacttcggttgggaaaacggaaataaatgcctcaatttggacacttttgtagaaaatcgttcttttttcttatgtgaaacctatgccatctgtgctattcttcaaacgaaagcctatgattccaggaataaaaggagttgttttctcagttttgaaaaatcagaagatgacgccgaaatgtttacttgtcaaagctgcagagcaagtggaagataaacgggaagaatataaagaagtattgcttcagctgaatcgcatgctcaagagggctgagccgcacaatgaatggagtgatcggctgaggcatacatatgaacagatgaaggaatatgcgctgtttgtgcaatcgattgagatgtttttgcggtcatccgcgaaaaaaatgaaataatccccctcgatcatgagggggatatttattttattttccgctaagacgcatcgccgaatgtttagtcggtccgatgtattggttcagcgggaaggattctttgattgccgcagtgataaattcttttgccgcatagatggcttccttcacttcagcgcctttggccagttctgccgtcacggcggcggagaatgtgcatccggctccgtgcgtgtaaggtgtatcaatcatttcgctttctaatacttccgcggtttctccgtcatacagcacgtcgatcgctttttcatgtttcaatttgccgccgcctgtaatcaatacatatttcgcgccgagttcgtgaattttcttggccgcttctttcatgtcttccaccgtttttaattcatccataccgctcagctggcttgcttcaaacaggtttggcgtgatgacggttgccagcggcgccaattgggtgcgaagcgcttcggcatgctccggatacagcacttcgttcgctcctttgcagaccatgacaggatcaataacgacattcttcagctgtttttctttaatcgttttcgccgcaagctcgatgatctccacggtagggagcattcccgttttcatggcgtctacgccgattccgtcaacaatcgtcgccagctgtgcgcgaatcgtatcggcatcaatcggaaatacttgatgatcccagctgttctccgggtccatcgctacgatcacggtcaaagccgtcattccgtatacgtttttttcttgaaatgtttttaaatcggcctgaattcccgcgccgccgctggaatcagaaccggcaatagtaagtgctttgtgcattgacatatcaatggcctccatcagtgttttatatctcattatagttagattttctcccgatcacaatacggaaggcttggaggaatgatttgacagccgcgggggatgtgcgtacaatacctacataagattactaggtaagggtgagaaaataaatgctcaacagggagcttgtaaagggaagcacggtcattctggtgctgacgctgctgaatgaacggcccatgtacgggtatgaacttgtgaaagaaatggagaaaagaagcgggaatgaactgcaaatgaaggaaggcacgctgtacccatcgcttcataagcttgaacgccaaagctatatttcttcttactgggaaaagcagaccaaagggcccgaccgaaaatattaccggatcaccgatgaaggaaaaaacattctagccgaacggacgaaggaatggaatctgttctccgctctgatggaccggatgctgaagcggggcgggcagaatggataaagacctttatgtgcacgaaatcagaaaagggctggaaggcaaggccggaagccgtgaattattaaaggaaatcgaaagccatattcatcatgccatttgtgttcatctggaaaaaggcaaaaccgaaagcgaagcgatggagcttattctgcgggaagtggggactccgtctgagattatctctgcttttcaaaaagcttcgacggtgcccgcgcggacttttatgctcttttatctgttctgcaactgcggtctttttgtgatgggggcgatgattacgatgatgcacgcgtggaggattcatcccgcagttgacgcgctgtggaaagggatttccgtgtcagtatggctgattatgatcggttatgtgctgtattggttccaaatcggctatcaagctggcaaagagttcggggctggcggcaaaaagcttgctgagcggacggtatgggcttcaatggtgccgaatctatgttttatgtttgtctttttgttcaatctggttccggctgggctgtttccttcggcggtcacaccgagttttgcggcagtatgcgccgttgtgacggtatgttttccgttttgcggcaaaataggtttttacgcaggcaggcagagacttgcctgatctttttcactatatacatagggaatctatataggggtgtttatatgagattaggttcgtggatgtacggcgcgtgcgcccaaatagccgttaccgtatttaccgtctgcggcttggttcttgccttgcccgttgtgagtctttttattatggttctgaatgggatgcaagacgctacttttgttgttttcagtattttgcttcttctattgttttatgcgctgggatggatttgggctgtttcgtttgcgcgtgagtggaaggtgaaacttttcgagctgcaggtcagctcgctcattccgctggcgggtatattatacttgtacattgacagcggggtgagtataccggaactgattcatgattggcatgaggatggatgtgcgcttgtcccgccggcttttgtctgcttgtgcacatgctatgcgatggtgttggtgcctgtttatcaatcaaaactgtggaatgccatggaggcgggcagacttaatgccaaggcggtatgcactgtttggggagaccttctgatcattctggttttgctggcggggatgacgtggatttgtttctgaatgggccgaaatcaaaaatcccccctgatctctccgccgctttatgttttaatagaacatgagaaaaagcagaaggagcgggtcatgaatatatcaattgtcatagtcacgtataatcggattccggctttgtgtgagctgctggagtcgatttccaggcagaccataaagccttatgaagtgatcatcgtaaatgatgccggggaatcggtcgaacaagcgaagcagctgtacagcgatctgccgattcagattattgatttagaacagaatgccggacatgtggaagcgcggaacgcaggtgtgaaaaaagcgtggggtgattatatcatgctgtgcgatgatgatgatttcattacgccgggccatttggaaagaatgacggctgcacttgctgatgcggattttgtccattctgacgcggaaattgtgtcatttgaagaacggggcggcacgagatacccggtgtcacgaaagccgttcgcctatacggcggattttgcggatatgcgggtattttccacgtacgttccgtcaggcagcatgtacagacgttctctgcatgacacgttagggtattttgatccggatgtccataattattgggactgggacttttatttgcgcgccgcgaaacagcaccgtgtgaagcgtgttccttgcgcgagcgtcatatatgcgttttttgagggaggcggcaatcagtccgcggatctcggcggcaaacggaagcggtacttagaccggttaagcgaaaagcacgggcttggggagctcccgacgaaaaacttcgcggttcttctagaagagccggacatgaagaggcgggaggcgccgactgacattgtgtgggacggaaagcccgtccattcaagactgcacagttcataagggggacggacagtttgaaacagcttttaaaagacagctggtggaatcagctgaaagatgaatttgacaaaccgtattatcaagagctgagagagatgctgaaacaagaatacagcagccaaacgatttatcctgacagccatgatatttttaacgccttgcattatacgccctatgaggatgtaaaagcggtcattctcggacaggacccgtatcacgggccaggacaggcgcacgggcttagtttttccgttcagcccggggtcagacagccgccgtctttgaaaaatattttcatagagcttcaggacgatatcggctgccccgtaccgaaccacggatcgctcgtcagctgggcgaagcagggagtgcttttgttaaacacagtgcttacggttcgccgcggtcaggccaattcccacaaaggcaaggggtgggagcggctcactgaccgcatcattgatgtggtgaatgaaagagagaagccgattgtctttatcctgtgggggcgtcacgcgcagatgaaaaaagagcgcattgacacatcgaaacacattattattgaatcgactcatccgagcccgttttcggcaaggaacggttttttcgggagcagaccgttttcccgtacaaacgccgcccttgaaaaaatgggggagcagccgatcgattggtgcatccccgacctgccgcaataaacggttttttgaggcgcttccgcccggcggaagcgtcttttttgatgttccgggcggtatgccgtcagaaaaaataacaaactcaattctgcgatccgctcagaaatttgataaaatgcaggaagaagacaaattactgctggaggatttactcatgaacatacatatctctgctttaattcagaagatggaagaagaactgaggcaggcgaaaacggcgacccgcaccgaggaggtcaaaatgcacgcggccgccatccgctctctgtgtgatgtcgtgctcggcactcagacgcacaccgctccggcgcctgtgcagaatccgattccgaaagcggcgccgaaaccttccgcgtctccttcgacagacccgctgctgcttgaaaaaatgatgggcagcgccgggctgaaccaatatcagaaaaaagcgaaagacgaacgtgaggaagacggaaacggggattccattttcgatttttaacaggagaggttgattgacttgaaactgatactcgggggtttgcaatggacggcatttatgattgcggctgcgattgtagttcctgtcgccatcgcacaatcatttcacttgaaccatgccgattctgccgcattgattcagagcacattttttgtgcttggcgtcgctgcggtcatccaatgtctccagggacatcgtctgccgattaatgaaagcccggcaggcttatggtggggcgtatacacgatttacggcggactgacgggcacggtgtttgcgacattcggcgagacgctgcgggcgctgcagggggcgctgttattaagcgctgtctttttctttttgttcagcctttttaaagtgattgaacggctggccgtgctgtttacgccggttgtgaccggtgtgtatctgctgctgttggtcatgcagctgagtcagccgattgtgaaaggccttttgggcatcggctatttaaaaaacagcgtcgacggccttgtattcgggctcgcaatggttgtgacggcggcgatgttcatcatgtcccgatcgaatgttacgttcttaagacagtatgcgattctcctttcgcttgccggcggatggatcttattcgccgtcttcggcgctgccaaaccgattcaaataccggatcgcgtgattcagctgccggttctttttccgtttggaaaacccgtgtttgacagcggcctgatcattacgtcactcttcattaccgtgcttttgattgtcaacatgctcgcgagcatccgggttgtagaagcggcggtgaaaaaattcggcggcaccgttgggaaacggcgtgagcgtccggcagggtttgcggcttcgatcagccaccttttgagcgggctgtcagggggcattgcgcctgtgccgatttcaggggcggccggttttattgagacgacgaagcttccttcgaaaaagccgtttcttttgggaagtgtatttgtcatgatcatcagtatgatcccgctatttatgaatgcgtttgcgagtctgccctcaccggtcggctttgcggtaaacttcgtcgttttctccacgatggcgggtcttgcctttacggagtttgactcttatgagaaagcggagcaaaaacgaatccgttccattatcggtctggcgctcctcacgggggtcggcgtaatgtttgtgccggagagcgcgttatcagggatgcatccgatcctgatttcgctcttaagcaacggccttgtgctcggaacgctgctggcgatagcgattgaccgaatccagcttatcaaaaagaaaaaatccgacaatctcgtgtcatcggatgacggacgttgaattttgccgatgttgggttatgattgaattggaaactttaacgaaaaggcgggagaaaaatagatgaaagtgtttattattcttggtgcgattaacgctttattggccgtggcgctgggcgctttcggcgcgcatgggcttgaagggaaaatccccgataaatatttgcaggtgtggcacacaggcgtgcaatatcatatgtatcacgcgctcggtcttctggctgtcgcgtttttggctgaaaagctctctggcgcaggcagtgtttctgttgcgggctggctgatgtttgcgggcatcgttctgttttcaggaagcctgtacgtattgagcgtgacgcagatttccattctcggcgcgattacaccgctcggcggcgtggcgtttatcatctcttggattatgattatcgtcgcggccgtcaaatatttataaagaaaaaaagccaatcctctgtcaagtgagcgattggctttttgatttatctcggagaataagaagacatggagtacggataagtataagcgatttcctcatcaaatgtgatgtaatcaaggtaaatggtcagaagcagatagcgggtgcccgttttcggatcgctgatgatgatatggtcacgtcccgccgcctcaatcacaccgcggaaaatctttgaattccattctttgctgttttcgaatgtcatataaatcgtcgccgttttgccccggttcaaccgcagaatattttcaatgtatgactcttcaatcggcagcatgccgggaacgttttgtgacgatgatggacctgacgggatttgaaagctgccgccgccctgctgctgcggctggccggggaaccccccgccgaagccctgctggccttgctgcatcggcattgtcatttgctgctgcatcggcatcatttgtgatccttggccctgaggctgcggataaggattaggcccgagctgcggctggaatccctgcatatccattcccatccccatcccctgcatttgctgatattgattctttttcggtttcatattgttcctcctttgatgaaaacctcttgatgctgaaacctcctgacaagtatcagacagccgacagagcggctgctgtttttatctattccaccatatgagcccaaagaaagatttatgcgaaaaaagaaaatacgatccaatgtttccggatatcagagccggctttttttgtgcgcgcaatgctgacttttcacataatagtctgtatccctagcgcatcttccgcataaggaacatatgatagcggtagtttcaggtgcgaaaagggggtgacgagttgcctaaagtgtcagtgatcatgacgagctataacaaaagtgactatgtggcccgctctattaaaagtattctgtctcagacgtttacggactttgagctgttcattatggatgacaactcaaatgaagagacattggcggaaatacgtccttttctcacggatgaccgcgtccggttttatcaaagcgatgtatcgggcgtcaaagaaagaacggaaaaaacacgctacgccgccttgattaatcaggcaatagaaatggcggagggcgagtacgtgacgtatgcgaccgacgacaacacgtatgtgccggaacggcttgagaaaatggtgaaagagcttgatgaagacccggaaaaagccgtcgtgtattcaagttccaaaacctatcatctgaatcagcggaaagagacggtgaaggagacggccaggcccgccgaacggatcgtgtggaacgcgccgtgcgccattgaccattgttcggtcatgcaccggttttccgtgctggaacaggtcaaatcggcattcggttcctattgggatgaaagccccgcgttttaccgtatcggtgacgcccgttttttctggagagtgaatcatttttatccgttttacccgatttctgaggaacttgatatcaattatattaccgatcaatccatccattatcagcttttcgcggcggagaaaaacgagtttgtgaacagccttccgcagcagaccacgtgccgggagctgagggaatcattaaaaaagcttggaaaggggtgagggcttgtcggcatacttagcgaactattgggtgctgtaccggcagtatattgacctttttcagtcacttcgctacaaagacatcccgctcgcattgatcagtaatttttatcaatatatcagtccggcgcttcgggagagcatggagcagaacccggagcttttcggtccggcggatcagcatattcctgaagccggtattcagccttattatgatcaaaaaaggcaaaacattaagaaaacagatgagaaaccggtaaacggaaaagtcattctgcatttcgatcatcttcggttcaccgagggaaattaccggcagtttgatccggcaaaaacagcggtactggccagatggagtctgcctgaccatcatgggctgcccgttatctgcaaattggagctgacgggaatggggcaaaaagggaaccccgtcccttatattgaaaaagcccattccattttgaaagagcttcacagccatcccgctttcggaaacagagaatttcaggaacgactgtataaagacatcccgttatttattgaagcgattgacgccgttgatattttgtttacggccgagaagatttccgccgttgtagtcggcacgacggaggatatttacagccgtgtgctggcgctgatgtccgcgaaaaaaaacgccgtcagcatctgtcttcagcacggggcgctcatgggagatgaagcgtttctgcccgtatttacggactatcaggctgtattcggggcttatgaagcggagtggtataaagcaaaaggctgcagggaggaacaaatcatcatcacggggcatccccgtttcgacgagattttctcaagagagccgatagatcgggacacgttttaccgcaaactttcttttctcccgtcacagcggacggtgctgatcgccacgcagccgttttctgatgaattttatacgggagtgcttgaagagcttgccggccaaaagaacatgcagctcattattaaaccgcatccgtgggaaatcggcaaaaacaagctggatgcttacaatcaggtgctgcggaaatataaagcaggcaaaatcatcaaaaaagagatggagctgtatgatattctcccgtttgttgacgctgcggtgacacagacatcaacggtcggtcttgaagcgatgctgtttcaaaagcccgtgctgatcggaaaatcagcgggaacccgccgatacccttattatcattcacttggagaatttgtttttgaggacccgcaggcactcgctcaggaattaatccggatatgcgaaagccccgcagaatatcaaaaagcggaacaggcgcgccgtgcttttgtcgccgcgaactacccggttcaggattcgcttgccgctttatgtcaagtgcttcaggaaaaaaccggagtcagcttcagacgggttgacccttcataaaaaagataggagcgcaaaaaaaatggtgcaaaaaagatcagcttttcttccctattcattgcccatgatcgggaaggacgaaattcaggaggttattgatacacttgaatcgggctggctttcaaagggaccgaaagtagaggcgtttgaaaaagcctttgccgcctggacgggggcaaagcatgcgatcgcgctgaactcatgtaccgccgctttgtttttggccctgaaagcgaaagggatcggtcccggcgacgaggtcatcacgtctgccgtgacgttcagttcaacagccaatacaatcgtgcacacaggcgccgttccggtgtttgctgacatcgatccgcttacgctgaatgcagaccctgaaaaaattgaggcggccgtcaccccgcggacaaaagcgattgtacccgttcatttcgccgggcagtcgtgtgatatggatcaaattttggccattgccgaaaagcatcagttatttgtcttagaggatgccgcacatgccgtgtataccacttataaacagaaaatgatcggatcaatcggtgatgcgacggcattcagcttctacgcgacaaaaaacctggcaaccggtgaaggcggcatgctgacgacggacgatgacgggcttgccgatcagatcagggtgctcagccttcacggcatgagcaaaggcgcgtggaaccgctattcttcaaacggaagctggtactacgaggtcgaaacgcccggctataaaatgaatatgtttgatcttcaggcagcgcttgggcttcatcagctgaaacggattgacagcatgcagcaaagaagggctgaaattgctagccgctaccaggacgctttcagagacatgaaagggctcaccgtcccatatgtcagtgatgacgggcggcatgcatggcatctgtatgttcttcaaatagaggagcaggaggccgggatcagccggaacgatctgatttccgctttgaaagaccaatataatatcggcacaagtgttcattttattccggttccgttccatccgtattatcaaaaaacgtacggatataaggaaactgattttccggccgcggccgcgtattatcaccgcaccgtatcactccctctttatccgtcaatgacagatgatgacgttgaatacgtcattgcagccgttacggatatcgtcaaaggggctgattaggtgtacagactgagagaaaatcttgcacaggacatgattcatgccttcctgcatcagaagggcattcagcccgaagcctatgaatcgtcgctctgtttattggaagaaaacagccttcaaggcgtgattttatatgaaaactcttcgtgggaaagtcaattgttccgaaaaaatatcatcaatgtgaagcttgcagccgcaaacagcaccggacagctcaaaaggctgtttcaggaattttacgcggcaaggcgggcggacggcactgattttatatttattaaaataccagctgaagatatcggcgcgatgcaggtcgtgcagtcgcttccgaacgcttattttgtagggagtcttctcaagctcgtcagtccggtgcgtgtatataacagcacgccgccgtttgagattacagaagccggacccggcgacacggaagcgatcagccggctggcccgcgacgcctttacaaaaagcaggtattatcaggacccccatctcagctataaaagtgcaaaccgtctgtttgaagagtgggcgcggaataacgcggaaggcagagcttcgttacaattcctcgccaaatataagggagagaccgcgggctttgttcaggggctgtctaaaggcgatgaattcgtccttgatctgatggcggtaaagccgggatttgaaggaaaaggagcgggattccatttagctgcgcacgtgattgaacaatcattgcgctttcagcataagactgtatcagcgggaacgcagctccacaatgtaagagccatccgcctgtatgaaagaatgggatttaaagcggatgcgtccttttactactatcatgtgtggcccgggaaggaggcggactgatggcatcatgcaaaatcggaacgaagtcaatcggcgaaggttcgcccgtattcatcatcgccgaagccggaattaatcatgacggaaaactgagccaggcgtttgaattgatagatgcggccagtgaggccggcgcggatgcggtcaagttccaaatgtttcaggctgacaaaatgtatcagaaagaccccggcttatacaaaaccgctgcgggaaaaaacgtctctattttttctttggtgcaatcaatggaaatgcccgctgagtggatcgaaccgctgcttgaatattgtaagaaaaaaggcgtgctgtttttaagcacggtatgtgacgaaggctctgccgacttactgtatgcgacttccccttcagcttttaaaatcgcctcctacgagctgaaccatctgccgttattgaaatatgtcgcggggctgaagaccccgattatcttttccaccgcgggcgctgatatttcagatattcaggaggcttatcaaaccattaccggcgaggggaacaaagaaattgcgatcatgcattgtgtggcgaaatatcccgcgccgcctgaatacagcaatctgagcgtcattcccatgcttgccgccgcattcccggatgctgtgatcggtttctccgatcacagcgcccatccgtatgatgtgccgtgcgcggctgtcaggctcggagcgaaactgattgaaaagcattttacgatcgataaaaacctgcccggtgctgatcactccttcgccctcaatccggatgaattaaaagaaatggttgcggcgatccgctcagttgaagcggagctgcggcaggggcatcacgctccggtgccggaagtgctgtcgggaagctcccataaaacgacgacaccgattgaaggggatatcagaaggtttgcttacagaggcattttttcaacagcgccgattcaaaaaggcgaatattttacggcggaaaaccttgccgtccttcgtcccggccaaaaaccgcaggggcttcacccgagatattttgagcttttaactgacggcgcgcgtgcggtcagggatatccccgccgacacgggcatcacttgggatgaccttttgacgaaaggcagcccatatgatgactgacattttgtttatcattcaggcgcggatgggaagcgggcgtcttcccggcaaagtgctgaaaccgatcggcgggtatacgatcctcgatatgattgtcaaaagggttcgtcaaagtgcgttttacgatcaatcacgggataatctgatcgtcgccgcgtctgacagcaagaccgacgacattctgtctgcgcactgcctcagcaaccgctaccgtgtccaccgcggcagcgaacagcgtgtgcttgaccggtttgcacaagtcatcgaacaagtaaaaccggacatcgcagtcagactgacgggggataacccgtttgtcgacccttcgctgcttgattttctgattcaatcgcatttagatcagcacgcagactacacgtatatctgcggtacaccgctcgggatcggcggcgaggcggtgaacgcgcgccttttaacggagatcaatgcggacaaaacgctggcggacaaatatcaggagcatgtcacccttttgataagagaatcccctgagaggtaccggcttctctttcctgagcccccgcaggaactccgggctcctcacttgcggatgaccgtcgatacagaagaggactacaggctggcccgcgagctgtacgtaaaagcgggctcgcgtcctgatattccggcaaaagaattgatccatctgctgaatcgtgatccggagctcagggccattaatcaaatgatccggcaaaaagaggctgattagcgtgcgggttttgattttcgcggacgggggccgtgacatcggcatggggcacgcggttcggatgaagctgcttgccggtgccattaagaacaactgctcaataacgttctacacaaataaagaggcttcttcttatctatcatctgatcaatgggaagtgatcatcaagcctgacaagggacagaaggaatttattgtccgggaaataaacacgcgggctcccgaccttctcatattcgatctgctcgatatgccgtgtgactggctggaggaaatcaaaaagcattcatcggctcgtatcgtcttatttgaagaaaagagggaacatgtcattcatttatgcgatgccgttataaacggcatttacggcgggctgaaaagccggacggttcaaatgggcagcgccgcggtatatgaaggcccggattatatgattcttcatccgggttttgaaaaagcaaagcagctctatcagctgagaaaagaatgccgaaccatattggtctctttaggaggaagcgacccgaagaagcttgtctttaaagtgatggaagcatgccgccgcatccctgatattcagcggaaacgagtgatcatcgtcatgggcggcgcggcgcctcatgctgatgacgtgcgcgcgcatctcacacaaatgccttatgccgagatggtaaggcagacaaatgacatggccgcgcttctcacgagggctgatatggccatcgtgtccggcgggatcaccttatatgagaccatttgtacaggtgtgccctgcatcgttctttctcaagtggagcatcaaactgagacggcggaaaaattcgccgcacgagaggccgccgttcatctcggcctgggagaacacaccgcggcggacgtgctcgctcggcatatgtctgagctggctgctgattatccgagacggctcgggcttcatcagaacggaaagccgctggttgacggcaggggcattaaacgggcggcggcgattctttatgatttgtgataaaaccacacgtaaggaagtgttcatgtgaaaggtgttatcttagccggaggcaccggctcacgccttatgccgctgacaaaagcggtcaataagcatttactccctgtcggtccatatccgatgatttactggtcgatcatgaagctggaagaagcggggattacggatatcttgctgattacgcaaaaagaatatattccgcaatttcataaacttctcgaaaccggagaagagctcggcgtctcaatcacatatcaggttcagccagccgcatccggcatttccgacggtttatcatacgcaaagcggtttaccgggcgcgatccgttcgttctgcttttgggagataatatttttgaagattcattaaaaccttatacggagcgtttcgcaaagcagggaaaaggagcgaaagtgctgctgaaagaagttgacgatccggagcgcttcggcatcgccgagattgatgaggaaaacaaacggatcaagtcgatcattgaaaagccggagcagccgccgaccagactatgcgtcacggggatctacatgtacgacgcagaagtgttttcttatattgaacaaatttctccttcaaaacgcggcgaactggaaattacggatgtcaataatttatacattgaacacagtgagctgacgtatgatgtgttaacgggctggtgggtggatgcgggcacgcatgaatcgctctatctcgccggaagcctggcgcatcaggcattacagaaaggacaggagcattaatcatgccaaaatcatatttaattacagggggcgccggatttatcggccttaccttcacaaagatgatgctgaaagaaacagatgcgcagattaccgtcctggataatctcacgtatgcaagcaggccgcttgaaatagaagccttaaaaaagaacggccgtttccgttttatcaaaggtgacatttctgaaaaagaggacattgacaaagtcttttcccaaatgtatgacgctgtcattcattttgcggctgaatcccatgtggacagaagcataaatcaggcagagccgttcatcacaacaaatgtgatgggcacataccgactggccgacgcggtgttacagggaaaagccggcaggctgattcacatttccacagatgaggtgtacggagatttggcgccggatgatcccgcttttacagagacgacgccgctttctccgaacaatccgtattccgccagcaaggcaagctcagacctgcttgtcatgtcttatgtgaaaacccataagcttcctgccatcattacgagatgcagcaacaattacgggccgtaccagcaccacgagaaaatgattccgaccattatcaggcatgccgtaaacggcacgccggttccgctgtacggcgacgggatgcagatcagagactggctgtttgccgaagatcattgccgcgccattaagctcgtgctggaaaaaggaacactaggcgaaatttacaatatcggcggaggaaatgaacggacgaataaagagcttgcgtcatttatcatgaaggagctcggtgtcgaggaacggtttgctcatgtcgaagacagaaaagggcatgaccgccgttacgccatcaatgcttcaaagctgaaaaatgagctgggatggcggcaggacgtcacatttgaagaaggaatgagaagaaccattcgctggtatacagacagccaagactaatcggaaagaaggggatccgattgacgaaggtattagtaaccggagcggccggtcagctggggcgggagttatgccgccagctgaagcgggaagggtatgaagtgatcgccttgacaaaagcgatgatgaacatatccgaccagcgttcggtgcggcactcgttcagccattacaagccggatatcgtcgtcaatacggcggcatacacctccgttgacaaatgtgaaacggagctcgacaaagcgtatttaataaacggaatcggcgcttattatgccgcgcttgaggctgaaaacaccggcgcgaaattcattcacatcagcaccgattacgtcttcagcggcaaaggaacacggccataccagaccgatgatcccgcagatccgggcacgatttacggaaaaagcaaaaaactcggcgaagaactgatccggttaacgggaaaaaaccacaccattatcagaacgtcgtgggtgtacggcagcggcgggcacaactttgtcaatacgatgctgaaacttgcggatacacatgatcaggttcgtgtcgttaacgatcaagtcggagcgccgacgtacacaaaggatttagccgaaacggtgatcggtctgtttgacaggccgccgggcttgtaccacgccgcaaacagcggagtgtgcagctggtatgaatttgccaaggctatttttgaagaaagcggcagaaccgccgccgtgctgcccgtcacgacggaggaatacggaaatgagacgccgcgccccgcttactcggtgttgagtcttgagtcgattgaacggcaggggctcggcatgaggcattggcgggaagcgctaaaggattatttacaaagggagggacagtgcaagtgatcgaaggcgtaaaaattaaaaagctgatcaaacacagcgatgaccggggttttttctcagaactcgtccgtgacgatgaacatctcttagagcgtttcgggcaggcttcctggtccaaaagctatcccggcgtcattaaagcgtttcactatcatgagaaacaggatgacctgtggtttttcccgacgggccacgcccaggtcgtgctgcatgaccttcgcgaagagtcggcaaccaagggagaaacggatgtctactacatgggagaagacaatccgatgctccttctcattcccaaaggcgtcgcacacgggtacagagtgctgggcgaaaccccgctgaccattatttatttcacgacaatgtcctacaatccggatcagcctgacgaaaaaagaatcccgtggaatgatgagagcatcggatttgactggcagacggctcatcggtagcgcacaagacgaagacagcggatgtcttcgttttttgtgctggttcatctcgtgaaaaataaatgattgaatattccaaaaaataatttacttccatggataaaggtggtagattattctcaggaaaagagaaacccaattcgcgaatggaatcatcagacacgcttttccggcagaggacgctctgaatcctatatgatctggaggaattcatgatgttaaaaagaaaatcattttctgcctttctcatcagtgctgcggtattttcagctgtgttcttgccatcttttcatgcgaacgcccaatctgccgttattgaagcgaaaaccgtcaatagtacgaaagaatacgcgacgtctgatattgaagtcacatacaagccgaatgcgctgcttgccgtcggcgccgttgaatttcaatttcctgacgggttcaacgccactgtgagggactctgtaaacggaagaacactgaaagaaacgcaaattctcaactacggaaaaacggtcagacttccgcttacccttgacttattgggcgcgtctgaatacaatctcgtcctggtgcgtaaaaaccttccgcgcgcgggcacgtatacaattaaaggcgattacgtaaacggtttgggggccggcagtctctacgccgaaacaaagctggttattgacccgcgttaatccgggatgaaagaggctgacaacagcctctttttttatgcgcaaaatcctggcatgaatcttgcatataaaaaggggtgtaacgacaatgtgaaagggattgatgggttttggtgtaaaagcgcttacatttcgttctgccggtaattgaagcttacacgtaaaatacgatgaggtgataaaacatgtcagccaacccgctttctaaaagcactcagaaagatgaagaaaaagaagttcttaatttgttcttgtccacacaatcgatcataaaagaagccctgcgcaaactgggctatcctgacaatatgtatgaactgatgaaagagccgatgcggcttttgaccgtacgcatccccgtcaaaatggacaatggctcagtacaggttttcacgggctaccgctcacagcataatgacgcagtcggcccgacaaaagggggcgtgcggtttcacccggaagtcagtgaagaagaggttaaggcgctttccatctggatgactttaaaatgcggcatcacaaatcttccttacgggggcggaaaaggcggcatcatctgtgatccgcggacgatgtcattcggagagctggaacggctgagccgcggatatgtgcgcgcgatcagccagatcgtcggcccgacaaaggatattccggctcccgacgtatataccaactcgcagattatggcatggatgatggacgaatacagccgcctgagagaatttgattcaccgggattcattacgggcaaaccgattgttctcggcggttcacaggggcgggagacggcgaccgcgcaaggtgtcacgatttgtattgaggaagccgttaagaaaaaagggattccgttggaaaatgcgcggatcatcattcaggggttcggaaacgcggggagctttctcgctaaatttatgcatgacgccggcgccaaggtgatcggcatctcagacgcccacggggctttgtatgaccctgacggccttgacattgattacctgctggataagcgggacagcttcggcacggtgacgaatctcttctctgatgtcataacgaaccgggagctgctggaaaaggactgtgatattctcgtgcctgccgcaatctccaatcagataacggctgaaaacgcccatcacattaaagcctcaatcattgtggaggcggcgaacggcccgacaacgatagacgccacgaaaatcctgaatgaaagaggcgtgcttctcgtgccggacattttggcaagtgccggcggcgtgacggtgtcttattttgaatgggtgcaaaataatcaaggcttttactggtctgaggaagaagtcgccggaaaactgcgcagcgtcatggtgaattcgtttgaatccatttatcagacagcgcatacccacaaagtcgatatgcgtttggccgcctatatgacgggcatcagaaagtcggctgaagcggcccggttccgcggctgggtataagtgttatccgcaaagagattttgcatcagttatatagcggatcgcaaaatttctttgcgttttcagattgcagctgacaggttcggacaagcttcgtccgctttcggcaaagattttcctatttttatcacaaattgctatgctggtatgcttcttgcatcttcattaagcgtgagcacacattacaaaatacggggaggaattctaatgacagtttcatacgcacacgaaccatttacaaattttcaggaagagacaaataaacaatcgtttcaggaagcgctggcttatgtgaattcacagctcggcaagcattatccgcttatcatcaacggtgaagcgattgaaacggataaaaagatcatttccgtcaatccggcagataaaaaagaagtgatcggttctgtatcggcagccggaaaagaacttgcggaaaaggccatgcaggctgcgctgcaggcatttcaaacatggaaaaaagtacggccggaacaccgcgcgaatgtgctgtttaaggcggcggcgatcatccgcagaagaaagcacgaattctccgcgtacctggtgaaagaagcggggaaaccgtggaaggaagcggatgcggatacggcggaagcgatcgactttttagagtattacgcccgtcagatgctgaagctgaaagacggttctcctgtaaagagccgtgacggagaatataatcagtatcactatgagccgcttggggtgggaattgtcatttctccattcaacttcccgcttgcgattatggccggaacggcggcagccgccatcgtaacaggcaacacgatactgctgaaaccggcggatgcggcgcctgtcgtggcggcgaaattcgtagaagtgatgaaagaagcgggcctgccggacggcgtgctccaattcataccgggcgacggaggagaaatcggcgactatctcgttgagcatccgaagacgagatttgtgtcgtttacaggctcccgcgcggtcggatgccgcatctatgaacgcgccgcaaaagtacagccgggccaaaagtggctgaaacgggtcattgccgaaatgggagggaaagatacggtgcttgtagacagagatgctgatcttgatcttgccgcttcctcaatcgtgtattccgccttcggattctcaggccaaaaatgttcagccggttcgcgcgcggtcattcatcaggacgtctatgatgaagttgttgaaaaagccgtcgctttaacaaaatcactcaccgtcggaagtccggaagattttgatacatacatggggccagtcatccacgaagcatcttataataaagtcatgagttatatcgaaatcggcaaaacagaaggaaaactcctgacgggaggcgaaggtgatgattcaaaaggatactttattcagccgaccatttttgcggatgttgatgaaaacgcccgcctgatgcaggaggaaattttcgggccggtcgttgcgatctcaaaagcccgtgatttcgaccatatgcttgagattgccaataataccgattacggactgacgggcgctctgttatcgaaaacccgcgcgcacattgaacgcgcccgcgaagattttcacgtgggaaatctatacttcaaccgcggctgtacgggagcgattgtcggataccagccgttcggcggcttcaatatgtcaggaaccgattcaaaagccggaggacctgactatctgattcttcatatgcaggcaaaaacaacgtctgaagcctattaatctttcggaaatagcgcgatgaaaaagagagtcgcgctattttctctatatgagggtaagggggatggaacatgtatcagcagctcagcaaaatgcttccggaggagaaaatagaagccattacgaaatcactggtggcgttaaacagcatcaacggcacattgggagaaggaaaaaaagccgactatatcaaagatatgatcaagagctttccctactttcaggagaatccgtcacatgtgtgggagcaggcgattcctgaggacccttacggccgcaaaaatattttcgcatttattgagggaaacggcgaaagcctgaatacggtcatttatcacgctcatcttgatacggtcggcatcgaggatttcggccctttaaaagatatcgcttttgattccgaccgtctcgcggaatatttctcaaactatgaatttgatcgggatgtgcagcgggacgcccgctcaggcgagtggatgttcggaaggggttcggttgatatgcagagcggtattgccgttcatctcgccaatctgcttcacttttctgaacggcgcgatcagctgccgggccatattctgttcatggcaaacccggatgaagaaagccagcattccggcattttaaccagcatttctgaattaaaacggctgaaacaagaaaagcagcttcgttatttagcagcgattaataacgattttatcacgccgctgtatgagggtgacacgacaaggtacatatacacgggcgcggcagggaagcttttgccttgctttgcgatttacgggcgggaggtgcatgtcggagatacgctgtccggcatcgatccgaatttgatcgcgtcagaaatcaccagaagaattcacaacaatattcatatggcggaaaacattgaaggggagcttgtgcttccgccgacctgcctctaccagcgtgacaataaggaagcgtataacgtgcagaccgccgtcagcagctatgtctattttaattattttatttacgagaaaaccgccaaagaagtcatggatcagctgaccgccgtggctgacgaagcctgcaaagagacagaacaaaaattatctgattattacgacgaatactgtgagagaacgagcctgccgaaaaaagagatgtcatggaacgttcaagtgtacagtctggaagattacctgaaaaggctgagaagccgcgggatagaccctgcacagtgtatcgggcaggcatttaaaacatatgaacatcttgaactgcggatgagatgttttaaagccgtcgaagaactgcaaaaactcgatcctgagcagggagccaaggtcattattttctatgcgccgccttaccttccgcacaattatctgaaggaagaaagcacacgggaccggcttttgcagcatgtcattcaagaagcggtcgataaaacagcggcatcaaccggagaaacattcgtctttaaaaagtttttcccttatttggcggacggaagctttttatcgctgcatgaaacagatgaggaggtctccgcctttaccgataattttccgggctgggatgtcatcgggacgattccttttaatgaaatcagggaattgaatattccgtcggtcaatataggggtatacggaaaggacggccataaatggacggaacgcgtgtacaaaccgtacacattccatgtgctgccggaactcattcagcagacgacaatgcaccttttgcacagctgccgattagacatacgcacaaatggctgacataacggaataagggggatgtatatgcagggagataccaatcaaaatgaattgcagcgcacgatgaagggccggcatttgtttatgatcgccctcggcggcgtgatcgggacggggctttttctgggctccggttttacgatcagtgaagcgggaccgatcggcgcgatattggcttatgtgatcggcggatttttaatgtacctggtgatgctttgtttgggggagctcgcggttgccatgccggtcgcaggatcatttcaggcgtatgccgcaaagtttctcgggccgtcgacgggatttacgatcggatggatgtacgcattcagctgggccaatacagtggggcttgagctgacgtcggcggggattttaatgcagcgatggtttccggccgttccgatttgggtgtggtgcctggtatttggcgtcgtcattttttccattaacgcgctgtctgcgcggagttttgcggaaatggaattttggttttccagcattaaggtcatggccattgtattgtttattattctcggctgcgctgcggtattcggctttgtcggttttaacggcgggcagacggctccgtatctgtcaaactttacgacggacaaagggctttttccgaacggcgcccaagccgtgctgtttacccttgttatggtgaatttttcattccagggtaccgaactggtcggaatcgcctcgggagaaagcgaaaatccggaaaagacgcttccccgctcgatccgaaacgtcatatggcggacgctttttttcttcgtgctggcgatgtttgttctcgtgtccattttgccgtatcaaacggcaggcgtcatcgaaagcccgtttgtggctgtgctggataaaatcggcgttccttatgcggctgatatcatgaactttgtcattctgaccgccatgctgtcggtggcgaattccgggctgtacgcttcgtccagaatgatgtggtccctgtcaaaaactaagatgggccccgcttccttaacgaaactgacgaaaaaaggcgtgcctctgaaagctcttttcatcaccatcgccatctccggtttatccctgctgacaagtgtagtcgcggctgaaacggtgtatgtgtggctcatttccatctccggtatgattaccgtcgtcgcgtggatgtcaatctgcgcttcacaattcgttttccggagacgctttctcgctgaaggaggaaatctgaaggacctggcatttaaaacgcctctttatccgatcgtgccgattctcggattttcggtttacggtcttatcttaatcagtctcatctttatccccgaccagcgtatcggtctgtactgcggtgtcccgctgatgatcatctgttacgcgtattatcacttcggtatcaaaaaacgcctgaagcgtgagccggcttcttcggaaaaaggcgctgccggataagaaaaaaagcccttcgcttaaagcggcgggctttactttgtgtttcgtttggccgacagaacataggatagaacggcacagaactgaaaaccgaaaatgctgacggccatcggccaggcattttcttctccggcaataccgacaaggggagcggcagccgcaccgccgataaagggcaggagtccgagaagagccgcagcgcttcccgcgcctttctcctgtttctgcatagccaaagaaaatcccgtcgtcgtgacgatcccgacagaagaaacaatgatgaataaagaaatgcagactgccgccaggcctaaaccaaacgcaagtgataaaagcaaagcgatgctcccgatgacggcaatcatcagaccggagacaaacagcttccgttcatcatgtgttttggccatccgtccggtgatttgggtggcgcatatgattcccgcaccgtttacggcgaacagcaggctgaacatttgggccgatacgccgtagatgttttgcagtataaacggcgacccggcaatatatgcgaacatgccggtcatcacaaatgcctggctgagcgcaaatcccataaacatccggtcgccaagcaggccgcgaaacgtcatcagcgtctcccggagtccgccgcttgtccgcttttccggcgggagtgattcaggcaacaccgtaagcacggcggcagaaatgatacagccgattaccgccagcacgataaatacgattttccagccggcgaactgaaggataaatccccctgtaatcggcgctaaaatcggcgccgccccattgacgagcatcagtaatgagaaaaaagccgtcaattcttttccggaatacatatcgcgtgcggaagcccgtgcgatgacgattccggccgccccggtgaaaccttgaataaacctcatgacaattaaaaacgaaacagaagggctgaaggcgcataataaagaagacagcgtataaagcagcaatgacagaatcagcggcttccggcgcccgatcatatcactgagcggcccgacaacgatctgcccgacagccagacccaaaagacaaaacgtcaggctcagctgcgcaagtgacgctgtcgtatgaagatcggccgccacttcaggcaaagcgggcagatacatatcgagcgaaagcggcccgaatgaagcgagcgtcccgagaatcagtaccatgccgaggcctgcgcgggcggcctttgaatcagcgttattcatttcatgacccccaccttaacaaatgattctatcactatagcataaccagacggcgtattttatatcatttattgaatataaactaaatattttatttaaaaatctgaatgtaaataaaaaatcagaattagttttcatgtgaaatgtaaaatgaaatataaggatgctaaactataaaacaacaaaagatagaaaagttttacggaagaggtgttcaaagagcatgaacagcaaacaaaccgatcacatcgaaacgaaacgccgatttccggtctgtctcgcgcttgctttgacattaggcgtatttgccgcgggttctgaagagctggtgatttctccgctgcttccggatttagcgcgggctttcagctcggatgtcagtgtgctggcgctttccatcagtatttacggagtgatgatttttatcggggcgccgcttctcgttccgctgggagataaatattcccgggaactcagtctgctggcgggactgcttatatttacggccggcacggtgatctgcgcgctggcgcacaatctctttttcttctttctgggcagggcgctttccgggcttgcggcgggtgcgtttgtgccgacagcatatgcggtggtcggcgaccgtgtgccttatgcgtaccgcggcaaggtgatgggtctgatcgtgtcaagctggtcgctcgctttgattttcggcgttccgatcggctcttttatcggcggcgttttgaattggcggtggacgttttggattttcgccctcatgtctgtcctcgttgcttcgctcattttcattgaggcgcgccgcagcacggcggatgggaataaaacagaagaggaaaacggacggcaggcaggcactttccgggatgcgctgaaggtgccccgtgtccctgtatatctcacgatcactttttgcaacatgatcggtttttacggcatgtattcctttctcggcacatatcttcaccgcgtgctgccgggtgggaatacagcttcagggctgctgatcatggtgtacggaatcggtttttccatgagcgtgttcaccggaaaaatcgcagataaggcggggaaaatgcgctctttgatcgcggcattggccgtgatcagcatatggctttcctgtctcgcctatgcgccgtcatcaatgccgtttttggtcatcgggttattcgtctggggattgatgcaaagcctgacggtgaccttgctcagcactattttaagtgattgctcacagagccgccggggcaaaatcatggcattttacagtctggcgtccaatttggccgtcaccttgggttctgctgtcatgggtccggtctatgtcggatatggatatgcagctgtcggatttatctgtgcggccgtcaccctcatcggctttgtcctcagcgttttcgcatacagaaggtatggaaaatatgagcataagaccgaccaatcattgtatcggtaaaataaagtttctataattttgtaaatgtaaatttttaacaccttatattataaggtgttttctaatatataggaataattatcaatattttcaaataatattgacagcttgaacgtctatggataatatttacttaaaatttaacagattggttggtgctcatgattatattggataatagcattcaaacaaaaagcaaggcttattcaatatctaaactgattacgatcaacacgctcggtcctgaagggacaagcagtgagtacgcagcaaaaaacttcatcaccaatttcacccttctccaaggggtgaacagcaaattatcattgcatgatacatttgaatcgtgcattgaaaaaacgcttcaaagtccgctggaatacacaattgtgcctcacgcgtatgacggcattaagcacttctacatgagaccggatctgcagcttctgcaaattttcaggtgcgacaccccgatgtacggcctggctgtccggcccggttttgaatatacggatgacatgcttgataagactgtcatcgtatcccacccgtctcctatcaatttgattaagtattttacccgtaaagatgtcacgtttgatctggtgaactcaacgagcgcagccgcgaaaagagtgaaggacggtttgtccgacatcgcgctgacaaatgagctggccagacaaaagtacggccttcactttgtcaaaacatttaaaagcattcccatgagctggtcattattcggaaaaggagagattcatgatgaaaactgaacaagatttgcaggaactttatttcccgacgcctaaattaatagaatgggataacggagtaagacaatattcgtccgtcagaggcgatacggaagttctgctttcttacgttccgccgcatacaaacgtggaaccgcatcagcataaggaagtccaaatcggccttgtcgtttccggcgagctgtccatgactgtcggagatgtcacaagaaagatgacagcgctggaatcagcctatatcgcgcctcctaacgtgcctcacggcgcaagaaatgagacggatctagaagtgatcgccattgatattaaacgcctgaaagccggtgaaacctatacaagccctgaggattattttttgaatatttttaaaacgagagacttattgcctgggatggaagtcacgttcttcgtggaagactgggtggaaatcatgcttgccaacattccgggcaacggaggagaaatgccgttccataaacaccgcaatgaacagatcggcatctgcatcggcggtggctatgatatgaccattgaaggctgcaaagtggatatgacattcggtacagcttatttctgcgatccgagagaagatcacggcgccatcaacagatttgaaaaagattcaaaatcagtcaatatctttttccctccgcgctataacagagcaaaagcgaaaaaattagaggcgaaagagtcatgaacctgacggataaaacggtcctcatcacagggggcgcatcaggcatcggttatgccgcggttcaggcgtttctgaatcaagaggcgaatgtggtcgtcgcggatattgatgaggcgcagggagaagcgatgatccggaaagaaaacaatgacaggctgcattttgtgcagacggatattacagatgaaccggcatgtcaaaacgccatccggtcagcggttgacaagttcggcggattggatgtgttaatcaataacgccggcatcgaaattgtcgccccgattcatgagatggagctgagcgattgggacaaagtgctcaacgtcaatctgacgggcatgtttcttatgagcaagcacgcgctcaagtatatgctcaaaagcggcaagggcaatatcattaacacgtgctccgtcggaggagtcgtcgcatggcccgacattcccgcatataacgcctctaaaggcggcgtactgcagctgacgcgttcgatggccgtcgattacgccaaacacaacatccgcgtcaattgcgtgtgcccgggaatcattgacacacctttgaatgaaaagtcgttccttgaaaacaacgaaggcacgcttgaagaaatcaaaaaagaaaaagcgaaagtcaatccgctgctgagactcggcaagcctgaagaaatagcgaacgtcatgctgtttctcgcttcggatttatcaagctatatgaccggaagcgcgatcaccgcagacggtggatacaccgcacaatagagaaggagtgtttacatatggagagaaaaacagtattggttatcgctgaccttgggggatgcccgccgcatatgttttacaaaagcgcagccgaaaaatacaacctcgtcagctttattccgagaccttttgcaattacagcctctcatgcggcattaattgaaaaatactcgattgcggtcattaaagataaagactattttaagagtctggctgattttgagcatcccgattcgatttactgggctcatgaagatcatgacaaacctgaggaagaagtcgtcgaagaaatcgtcaaggtggctgacatgttcgcggttgacgccattacgaccaacaatgaactgtttatcgctccgatggcaaaagcgtgtgaacgtctcggcctgcggggagcgggcgtacaggccgctgaaaatgccagagataaaaacaaaatgagagccgccttcaaccgggccggcgtcaagtctatcaaaaataaacgggtgacgacgctggaagatttccgcgccgcgcttcaggaaatcggaacgccgcttattctgaagcctacatatctggcgagctccatcggcgtgacgctcatcaaagagagggaaacggcagaagcagaatttaacaaagtcaatgaatacctgaagtcgattaacgtaccgaaagcggtcacgtttgaagcgccttttatcgcggaagaatttttgcagggcgagtatgacgactggtacgaaacaagcggttattccgactatatcagcatagaaggcatcatggccgacggggaatacttccctgtggcgattcatgataaaacaccgcaaatcggattcacggagacatcgcatattacgccgtccatcctggatgatgacgcaaagcggaaaattgtcgaagctgccaaaaaggcgaatgaaggactcggcctcgaaaactgcgcgacacatacagaaattaaattaatgaaaaaccgggaagccggactgattgaatcagcggcgcgatttgcgggctggaacatgattccgaatattaaaaaggtcttcggcgtcgacatggcgcagctgttattggatgttctctgtttcggaaaagaagccgatctgccgaaaggattattggagcaggagccatgttatgtcgccgactgccacttgtatcctcagcatttcaaagagaacggccagctgcctgagacagctgtcgatttcgtcattgaaagcattgacattcccgacggcgtcttaaagggagacaccgaactcgtttctttctcggctgccgaggcgggtacatccgtggatctgcggctgttcgaagcgttcaacagcattgcggcgtttgagctgaaaggaagcaattcgggtgacgtggccgaatcaatcaaacaaattcagcagcaggcgaagctgactgcaaagtatgcgttaccggtatgaaacagctgaaaccgaactcgaagtatttgcttttcgggcaggcgctttcgtttatgggagactattgcgttctcccggccctgctcattttgtctacatactatcatgactactgggtgacgtccggcgttatcgcggtccgcagcattccgatggtgtttcagccgtttttaggcgtgctcgtggacaggctcgacagggtgaaaatcatgctgtggacggatgtgatcagaggtgtcatctttttggggctgacatttctcccgaaaggcgaatatccgctgctttttctggcgctgctgtttgtctcgtacggaagcggcgtgttttttaacccggcacgtctcgcggtcatgtcgtctttagaagcggatattaaaaatatcaacactttgtttgcaaaagccacgacgatttcgattattgtcggcgctgcagccggcggactttttctgttaggcggttctgtggagcttgccgtcgcgtttaacggggtgacctatcttgtctccgcgtttttcatcagccgcattaagcttcaatacgtgccgattcagtcagaaaacgtaagagaagcttttcagtcgtttaaagaaggcctgaaggaaatcaaaacaaatgcttttgtgttaaacgccatgttcacgatgattacgatggcgcttttgtggggtgtcgtctacagctatttcccgattgtcagccgctttttaggcgacggggaaatcggcaatttcatcctgacgttctgtatcggcttcggcggctttatcggcgccgctcttgtcagcaaatggggctttaacaacaataaagggctgatgtattttacagtgttatcgatcgtctcgcttgcgctgtttttgtttaccccgattttcgccgtgtcagtcattgccgccattcttttctttatcgcaatggaatacggtgaagtgctggcaaaggtcaaagttcaggagaacgctgcgaaccagattcagggccggatcttttcggtggcggaggcgtccatcggattgtgcatcgccgccggttccatgctgatcaacattgtagacgcggcagtcatcatggcgtttatcgtccttttggtcagcgggctgtttctgcatacaaaactggtcaataaatccttttcagaacggaataacgaatcagagcaaatccatttataaggagccttccagatggaaatcataccgtccgatgtcatcaagacacttccgaaacaggaattttcgctcgtttttcaaaaggtaaaagagatggagaaaacgggagcccagattattaatctcggccaggggaatcccgatctccccactccgccgcatatcgttgaagcattgcgggaagctgcgctgaatccttcatatcacggatacggccctttcagaggctatccgtttctgaaagaagccatcgcggaattttatgagagagagtacggggtatcggtcaatccggagacagaagtcgcgctgttcggcggagggaaagcaggtttgtacgttttgacgcaatgcctgctgaaccccggcgatatcgccttagtcccgaaccccggctaccctgagtatttatcgggaatcacaatggccagagcggagctgcatgagatgccgcttcatccggaaaacggctatctgccggattttgagcggattgatcccgccgtcctgaaaaaagccaagctgatgtttttgaattacccgaataacccgacgggcgcgactgcggatcaggcgttttatgaaaaagcggctgcgtttgcaaaaaaatatgacatccatcttattcacgattttgcatacggcgcgttcgaatttgatcagaacccggccagctttcttcaggcgaaagaagcgaaaacggtcggcgcggagctttattcattttcgaaaaccttcaatatggcaggctggagaatggcatttgccgtggggaatgagaaaatcattcaggcggtcaatgagtttcaggatcacgtcttcgtcggcatgttcggcggccttcagcaggcggcagcggcggcgctgtcaggaaatcctgagcatacggagcgtctgaagcgcacatataaagaacggattgattttttcacggcgttatgtgaaaaggaattaggctggagcattgaaaaaccgaaagggactttttatgtctgggctgaaattccgaatgaattcgagtcttcacaccagttttcggactatctgctggagcatgcccatgttgtcgtgacgcccggcgagattttcggcagcggcggaaagcgttatgtcagaatatcaatggtggcaaaacagggcgatttaagggaattcgtgctgcggattcaaaagctaggtttgtcctttccttcattacaagaaacatcccgctgagagcgggatgtttttattatatgcttttcatgctgccgccgtcggctgacacttgctgtccggtaatataggaggcttcttcagaggcaagaaaggcagccagcgccgcggtttcttccgcagttccgacacgcttcatcgggacgcctgaggcaatccgttcctccgcttccgctttagaaatgccgttttgcttcatgacattctttacgaattggtgataacggtctgtggcgataaatccgggattcagacagttgacagtaatgtgaaaaggcgcaagctgaatggcgatgtttttgctggcattaattaaagcggcgttcatcatgctgttggtaaacatattggcgccgggttctttccataggtttccgacgatattaatgattctgccgaattcgtgctgtttcatgatcgctgcggccgttttcatagagtcgatataggcgatcgttttattcgtaaaggtatttgtcatatcctctatatcgcagctttcaaaggtatccggcgagccgcccggaatgttgttgatcaatacatcaagccgtccgcattgtgatctgatctcttcaaaaatgccggctctcgccttctggtccgacatatcgccggccagaacggtgacgcccgcatccggatgtttggcgaggatctcttcttttaccgattcgatattttcgggaactcgtgaattaatgacggtatgaaagccattgtccgccagtttcagagcgatcgctttgccgatcccctggctggctcccataataaatgcggttcgttttgacaactgtctgcacccctttaccaaaatggaatctcctttacatcgtaaaaaaaaatgataaaaatagcaaattttatttaaattctgacaaagaaaaaacccgccggacaggcgggtgggtgttacacgtgcaaaaacttcggaagcgtgtcaagagacaagcggtttccgacaaaaaatgaaccgaattctccgtagcgcgcgctgacttcatcaaagcgcatttcataaacaagttttttgaactgaagcacatcatcgctgaagagcgtgacgccccattcgtaatcgtcaaaaccgacagaccccgtgataatctgtttgactttgccggcatagctccgtccgatcaagccgtggcttctcatcaggtttctgcgttcatccatagaaagcatgtaccagttgtcgttgccgcttcttcttttatccatcggatagaagcagacgtatttcgcttccggcagctcaggatacaggcgtgcgcggacatgcgggttttcatacggatcgccttctccgcttgcgaggtagttgctcagctcaaccacggacacgtaagagtaagccgggatcgtaaattcagcaagctttgatttgttaaattcaagctcgatttcgttcagctcttccattgtcgggcgaagaatcatcagcatgaaatcagctttctgtccgacgatgctgtagatggtttgcgagcctttgccttctttttgggcgacgccccatttttcaagcagtcccgtaaattcgtgaataatcgacaggcgctcatcgctggataacatcttccatgacgtccagtccattgtgcggaaatcgtgaagcgcgtaccagccgtcaagtgtttgggcggcttcgttcgttttttgctgctcactcatgtatcttcactcctatatcttttcattacattgatgccttcactatatcacagtttaaccgtttcggctgtggagaaaccttgaataatccgaagccttgtgtcagaaactaagccgtgaaacaaaccgtcaattaaattagttagaaaaataagatttctttttgaaagcgctataatagaagttggttatttgaatttagctggaagaagagtatgctgtaaaagtaagcgttttttgtcaacatagaggagggaatatcgtggcagatttatttacaaaagtacaagaaaaagtcgcaggaaaagatgtgaaaatcgtatttcctgaagggttggacgaacgtatcctggttgcggtcaacaacttggcgggcaacaaggtattaaagccgatcgtagtcggcaataaagaagacattcaagcaaaagcgaaagaattaaatcttacgcttgacggcgtggacatttttgacccgcatacatatgaaggcatggaagaactcgttcaggctttcgtagaacgccgcaaaggcaaagcgacggaagaacaggcccgcaaagctttgctggacgaaaactatttcggcacgatgcttgtgtacaaaggtctcgcggacggacttgtcagcggagccgcacattctacagccgatacggtgcgccctgcactgcaaatcatcaaaacaaaagaaggcgtgaaaaaaacatcaggcgtcttcatcatggcccgcggtgacgagcagtatgtgttcgctgattgcgcgatcaacattgctcctgacagccaggaccttgccgaaatcgccattgaaagcgccaatacggctcaaatgtttgacattgacccgcgcgttgccatgctcagcttctctacaaaaggatcggcgaaatcagacgagacggacaaagtggctgaagccgtgaaaattgcgaaggaaaaagcgcctgagcttacgcttgacggcgaattccaattcgacgctgcatttgtgccgtctgtcgcggagaaaaaagcgccggactccgacattaaaggagacgcgaatgtatttgtattcccaagccttgaagcaggaaacatcggctacaaaatcgctcagcgcttaggcggctttgaagcggtcggaccgattctgcaaggattgaatatgcctgtaaacgatctttccagaggatgtaatgcggaagacgtctacaatcttgcgttaattacggctgctcaagcgctgtaatccgcaaaagccggtctttacgaggaccggctttttttatagaaagaatgtcactgcggcccagccgaacagggacaaacagagagaaccgatcaagcctgctgcgagcgcccgccagccgctatgacgaaacgccgatatatggactttcaaaccgagacccgccatcgccatgccgattaaaacataagacacttgaacaagaaacgcggaaaacgaagctgaaataacgcctgatgtatggatggcgctcattccgagaaatccgaagataaaccaagggatggggagcgaagcggcagaagccgtctttgactttccgctgcggcgcgcccgcattccgagcatgaatgcggccgggacgagcagcgcgacccgggtcagtttgacgatcaccgccatctcgacggctgcttttcctccggcgctgccggccgccgccgcatgcgccacttcgtgaagcgttgccccgcaaaaggccccgtaagccgcaggagaaaaccccaatccatgataagcaagagaatatacaacagtaaaaacggttcctaataacgaaacggcggccgcgctgatggcggctgcattttcatttgatctgatctgcggcgcgatcgcggcaatggcagccgccccgcagatcgctgtgccgcaggctgtcagcgtgctgagtgtctgatctatacggaacagccgggacagtccgtatacaacggcacccgcaaacatcatacagcagacggcaattgcaaatacgtgccagcccgcatgatagatatccgccagattcagtctcatgccaagcaggatgatgcctgctttcagcaagtatttgcttgagaacgcgatccccggctctaatgccgcccgctgtccgaatacggcgcgccagagcatgccgatcagcatggcaaggacaagcattccgagcatatgcaaaaacggcaggcggctgacatagaaagccgcaaacgcaattcctgcggtaactgaaataccctttatcatcttcatctcagtcacttcccattatcttgataactccactttactgcggtcttaatcattagtaaaatatatttatatgatctaaacgattaggaaaaataatgattaggggcgatgctttttgtattacggggaactgaaaacattcattgccgtcgtggaagaaaaaaactttacaaaggcggcgcagaagctgatgatttctcagccaagcgtcagccttcacattaaaaacctggagaaagaatttcaaaccgctttgctgaaccgctctccgaagcactttacgacgacgccgacgggggacattctctatcagcgcgccaagcagatggtctttttgtacgaacaggcgaaatctgaaatttacgcccaccatcattatgtcaaagggaagctcaaaatcgccgcgagctttaccatcggcgaatatattctgccgccgcttctcgcaaagcttcatgacgagtatcccgagctgaacctggacgtcatgatcggaaacacggaggaggtcagcgaagcggttcggatgcttcaagccgatatcggattaattgaagggcatacggggaaaaacgagctcgacattcagccgtttatggaggatgaattgtgcattgccgcaccgaacggacacccgctcgccggcagaaaaaacatcccggctgccgaattgcaaaatcaagcgtgggtgacaagggagaagggttcgggaacgagggaatatttagaccacgtccttcaatcaaacggactgcggccgaaatccatgatgacgatcagcagcaaccagggtgtcaaggaagccgtgatcagcggaatgggtctttccgttctgtcaaaaagcgtgctgcaaaaggatctgcttcacggcagcatttccgtgcttgagataaaaggattctccttaaaacggaaactgtctatcatccaatcttccattatggagaacacaaaaaacaaagaaatcttcatcgctcttttgaaaagccaatttcaatcatctcaagcggagtgatataataaacgcatggaaagcttatgacgaaagggatttaatatagatgggaaagcaaccgattgatttactgatgcagccgagctggagaatcattgaccaatccagccttggcccttattttgatgcgaagcagtcattcgcaatggatgatacgctgtgcgcctccgtaggcaaaggggaatcgcctgcgacggcacgcacttgggtgcaccaccggacgatcgtgctcggcattcaggacacacgcctgccgtttttagaggacggcgtgaaattgctggagggcgaaggctaccgtgtcattgtccgcaattccgggggcctcgcggtcgttctcgatgaaggcgtattgaatatttctcttatttttgaagatgagaaaaaaggcatcgacattgacagaggctacgaggcgatgacagagctggtgcggcggatgctgtgtccgtacaatgccgaaattgaagcatatgaaattaaaggatcgtactgtccgggcagctatgatctcagcatcggcggccgaaaattcgcgggaatctcacaaagacgcctgcggggcggaaccgcggttcagatttacctctgtgccgataaaagcggaagcgaacgcgccgatctgatcagacgtttctatcaagccgctttaaaagacaaaagcaacgatacaaaaggcgtatatcccgatatccggcccgaaacgatggcttcattaagcgaattgctgcaaacggacattaccgtgcaggacttaatgctggcgcttttgactgaactgaaggaactcagcggacgcctgtatgcagccggattatcgccggaagaggaaatggtatttgaaaaaaatctgatccgaatgctggaacggaatgagaaggtgttcggcacgcaggaaagcttggactgagtccgggcttttttatttttggtaattatatactattcagttatagtgaaaaagaatcgttatatcaaaactagtttacattatataccttatttgattaatatatttatgtaggttccaaataattctataaactgaaggagatggagatatgaactttaaaaaaataaaagaagaaaaaagaatcacgatccctacacatttgttagccggagatgcggaacaatcaggcaattctttcgcttggagcggctgggtgcttgtagtgccgagccaagaagacaatcaaaacccgaatttgaatttctctgatttagccgctcaaaagtaagataatgactgtttggagcctacgcattcgagacgaggcggtgagagtgtgacacaagagtatataagagaaattaagcggggagcactgtcatggattgttgaaaatatccattattttgatatgaaacataaagtagcgaatgatttcagatggcgccttaaaacatttatagaactcatttttcttaccaattacctgatcagaaatcaggcagatgataaggaagttgctgttttaacggagtttattacagaaaggctccgtaatgatcagcttgaagaatttattcattttgatccggacggtctcgccggattggctattgcgggtgaatttcttaccttgactgatcatccgtcacaagcttcagtgatatgggagctggaaaaattcacggcagcgcgttttgattgcagccttgctaaaattccctttcgaaaaatggatctgaagtacagtctgcaaagagcaggcgtaacctcggaaataacggatttttctgacttatatcactacacagcagctggtcaggatatcccaaatacatatatgacggatcatgatgcatacagtatcactcatacgattttttatataacagacatgggatgttcttctcttacggataaagagtatcatctgtcgtccttaaaagaaaaggtcctgaaatttctcgggatctatatctgtcttgagaatttagatattaccagtgaattattgatgtgcagctcttttttacatatcgacatggataaggacaaccataaaccgctctatgaagcagcctggaataaaatctatcggggccaaatgaaagaggggaatgtcccgagcatcacctatcaacataaacccggtttgaaaggtgaacagcgaagagaagatgtgtttaaacattgctatcatacaacacttgtcgccgcgggtgccgcgcatgcctgccttagagcagaaaggaacgattaacttgaacagattagctgaagagacggatcaatttttattatcttttgctgaacaatcgcttccggatcaaaagagcattcagctgtttgccggcttctgcaaatactacagaaagacgagccattcttccgctgtaaaagaacatactgaaaggattgcctccgctttcgttgataagtcatgctgggaagatctgtttcactgtaacacggccattgtcaatgagttgattcatatctatttaacggcaaaagcttataaaaagaagcagggaatggattcggatgatcaagtcatacgtcacggattgcaaaacggctatcttataaaaaaagaatggccttattttaaatacgccgaattcgccggtttgctgaacgagctgggaatgtcaactgaccatgaaaaagtgcgcttttacaagaattcgatatttcagcctttgctccatgacgcatggaaaagaacagctgaaaacgagctggagtttgtcgagtactgtcttcttcatttagatcagggagagcatctgcttcatcccggcttgaaggcgtccattcaaaaatggcttgtgttttgtctcggcagccgaaaaatgaaacagctgtgcaatatgttatttatccaatcgtgtatcgatccatttttttatggctgtcaagcggctcttcatcatataaataacgagaatccatccattcattgtgctccggctcttctgccggcgattgagattctgaatctggagtgtggaacatgcggatagtcaaggaacattttaatataaaaaaaacagaagaatggctgctgggtttttggaagaacattcagctgcagccggaagaaatggaagcagatgatctcatgcacctgttttgcggtttagcggcatgtcatcactttgaaaaaagaaaggatacagaagaagtcattctattcttagaccgttattttggagaaaaaacgcacgaatgccatccggtcctgttcgcgtatgcgtatcatatataccgcaggatgaatgccgcaaaaagcatcttttttcataacggacttgaacaaatggtccgcggtttacaagaggaactgaaatcagagccttcctctatgatcctcatggtgttagcagcttattttggggcggtgaccccggaagaactgatcgttttcttagaaaccgcaatgaaacgtgaggccgatttgctcatggcaccgggcagcatccaggaagagcaggcagatgccctttatgccgtctcttatttgcaaatgaaaaaattgcagccttttctcacggaatggtacaaaacatcagactttgctttttcaggtttaatgttagccgagtgcagaaagtatcacattgacgccgttgcaaaatacacagccattatgaaatttctccgattcgatgaggcgctttttatacgggaagggcgggaatttctacgctttcagcagcgaagcagcggaagcttcggttatttaaatccattagcgatggaccaaggggcggtcagcggcaaattgctggaccgtcaatatttcctgccgtccgctcattatgccgccgcctctctgtctatgctgtaatgtctctcttttgaaagacggaaaaagaaatcaataaacaaataagaaagtagatcgctataaccgtcacggaataggggatgtttaacgttgaaatcgcatcacccgcacttttatttacataagcaacgaggtttaaatgcggaaagagtgtaaatttataccatgtaaattgggcaagcaaatcagttccgcccaatatactgccggcaaacagcagtaaaatggataagcaaagggagagcgcctggcttttgcacaatactgacaaagtgaacgcaatggtgacaatacttataattgatatgaaacgcaaaagcagaatgattccggatgctttgattgaactgatggtatacagactgtcatttaaatgagtatagacgagcggatatgaagcattggaaaaaccgaataacacgccgccgatcagcaaacagctcacacagtaaaataagtaaaccatgccggtaaacagaagagaggccagaaatttcgatgttaaaatccgccatcttcggttcgggcttgtagcgataaacttaatcgtcccaagggcaaactctttagaaacaaccccgctgacggttaaaatcgcagtcaagcttacgaaaatctcaagcccgtttgaagtaaccgtgccgaaaaacctccagccgttccattcataagggttgatgttatgctccaaataatagtctttattcttaacatcagcagaataataaacgcctgccgtttcagccggtttattaatttcttcctgttttttttcggcgagaagccgttctttccaattgttatccgaggaagcatctaactcatgattcataataaggccggccagcaaaacgatgagaaacaggaaaaaaagagataaaagtgtgcctttttttcgggttatttttatgaattcgttctgcgtcagatgaaatatgctcataccgcgtcctcctgatctgtaatcatcatgtatttctcttccaatgacaaagtccttgcagaaacgcgggaaatcagaatctctttctctgccaaagttttaatgatatacgggatggtatcttcctccgcttccaattcaatgatgcggctgtctttttgctgtacttgaagaataccgtcctgctctaatatttctttcgcccttgccggatgatcgaccgtgacggtaaacagctttttctgaccaaggtcatttctgctcttcatgtcttcaattcctaaaatccgtccctttttaatgtaggcaaccctgtcgcaaatctcctccatttctgacaataaatggcttgataataaaatggaaaccccttgcttcgctaaatcggaaagaatgatgcgcaattctttcatacctttaggatcgagaccgttcatcggttcatccagaattaataacccgggattgtgaagaagagaataagcgagccccaagcgctgtttcatgcctaatgagaaatgtttcacttttttgcgggcagcctgctccagtccgacttttgcaagggtattcataaggtcatccgttcgcagcgaggtgctgcgcagtttagtaaaatattttaggttttgcaaagcggtcatattcggatacatatccgggccttcaatgataaccccgatatgtctcataaaatattcaaagtcgctgtccggtctgcctctgaatgaaatggctccttctgtttttttaataagctgtacgatcattctgaaaatagtggttttacctgagccgttcggccctaaaaggccgaatatctcgccttttctcacatcgaaagaaattgactgtacaataggggtatgattgatggttttagagacatcttttaatatcagggctggttcactcatgctacttgcacaccttccttatgatttagggtaaaagccgtcaaaaccgaagaacatgcttccgatcaggccggcagcgattaaaatgagagcaatgctataccacatttttcgattcaatggtttccctccttacaatgctgacattccatttgaaatagcgcaaaaagatgcggaatatcagtttcgaaagatcaaatccggccataaacaccgccatacccgctccgaggaccatacatccgttaaaaatggctgttacaatcggcacttttatgaggagaaagaatgatccggtcatcagcatcaggccgattgccatcaaacttaacaccgcaacagaggcaaaaagaaacggtgtcagcataaacatgaagttgaacatgcccatacccagcatcaggccgaatgctttgaaaaaggagcgccatgttttctgctcctcggcatcactgatgaaaatatccgcttttaaggcgcgcgcaagtgttttggggtttcctaaattgccggcgatttgttcatcgctttttccttcagcgacgcccatttggaatatttcgccgatatcggcgagtatctctttttgctcaaattccggcagatcttttatttcccgccggagatgttttaaatattggtctttacacattcattttccctccttaatgatgctgttcactttttcggacaggtcaagccattccgattttaatgtgtgatgataaaaggcgccttcttctgttactttgtaatatttgcgtgacgggccttgatctgaagctgctgtatacgtttttaaatagttatttttcgtaagtcttcgtaatatggggtagatggtgccctccgatacagggaacgtttcacttatgaccttgattaattcataaccatataaatcttcataaagaagcagggacaacacacaaagttccaatgctccttttcgtaattggctactcatttactatcattcccatcatatctaataattgtattctctatacagtgtattgcacagtagctaatcgatcaataattcccaagaaccatttgggatgaggaattgaatctttatgcttatgtgcgggcggggaccgagatgcgcagcccttgcgggaagaaggcctcctgaacaatgtttacattaatatagatcaggatgcgcgtcattgacaaatggcaaaaacccctttttccatgacaagaaaaggggttttttgcgttattcggccattttttctaaattgccgttccggtccattttaaaggacggagacgcatgctcgtcgtcttcaaataaaactagttttctggctctgttcataattttcaccaaggtttcgtagtcttcctgaatggttttttgatctttttcaagtttttcgacggccgcttccagctgctcggttttagactgaagttcttggttttcccgttttaaacggtcattttccatctgcagggcggaagtttgctttccgctgccttcatagctctgcagaaattgaatgacgtctgccattgtgagctccgccttttggctcggctgctgaggcgccagcaaatgtgataaactagctaactcttccttgaagctttcatcgacataaggcatatgttcgccggacatgacggcttgccgatcctcttttggcgcttccgtttgaaccgtctcttcggctgcggtttcttgaatgatgtccgcatccggtgcaggcggctggtataatagtttcttcttggccggctggccgtttccgagcgcgcgcatccgctgtttccgctgtttttttgcaagctgaagcgctttttcatattgatggcgcacgacggcattccatctgaatccgcacgctgccgacgttctgtttaatttatcgcctacctcttcaaaggcgttcagctgcgtgcttccttcccggacgtgccggagcacggtttccgcaagcagcaggtcattttcctccgaccaggcgtcctgtctttgctttgtcaatgttctcaacccccaataatctttgatggtattagaatgtccagattggaaaatatttatacaaattggctgaaagaatgagagatacgcagagccttgcaggataagatgaatccttgtacaataaaacgtgatgtgatttttttcgtttttaaaatttaagatttaacatagaggaacattgaatgaagggaagcgtacatcatggctaatgaattccgagtgtgtgatgattgccaggccaccaatattaagacattgctgccgcgtttgaaagaagctgacccggatgcaaaagtggaggtcggatgtcagtcatattgcgggcccggacgcaagaaatcgtttgctttcgtaaacaaccgcccgctgtcggcgccgactgaggacgagctgattgagaaagtgaaaaagaagatcaaaaagtaaatgtgcatttttacgacagcctcgcccgatgggtcaggcttttttgcttcaaaaaatcaatgattgaaaactggaacaaaacgccggacaaattcaaggatgttttcaaattacagagccgatataatagaatcacggctaaaaaaaagagggaatgacgatggcgtatccaaacggaaaattatcagaagaaaaagtgtttaaagatcccgttcaccgctatgttcatgtgcgggacaagctgatctgggatttgatcggcacccgtgaatttcagcggctgcgccggatcaaacagctcggtacgacgtatttgacgtttcacggcgcggaacacagccgttttaaccattctctcggcgtctatgagattgtcagacgaatggttgatgatgtttttaaagggcgtcctgaatgggatgacaatgaacgcgaactctgtctcagcgccgcgcttttgcacgatttgggacatgggccgttttcgcattcctttgaaaaggtttttcatctggatcatgaagactatacgagggaaatcattctcggcgacaccgaggtgaatcaggttctcagaaaggcgggaccgggatttccgcaggatgttgccgaagtcattgccaaaacatacaaaaacaaacaggtggtcagcctgatttcgagccagattgacgccgacaggatggattaccttcagcgggacgcatactatacgggcgtcagctacggacattttgatatggaacggattttaagggtcatgcgtccgcgagaggaccagatcgtcattaagcaaagcggcatgcacgccgtcgaagactatattatgagccgctatcaaatgtactggcaggtgtattttcatcccgtgacgagaagcgctgaagtcattttgacgaaaattctccaccgtgcgaagcagctccatgaagaagggtatatattcactcatgctcccgttcatttttattccatttttgaagggaagctgacgcttgcggattatctgaagcttgatgaagccatcattttatattatttccaggcttgggaggaagaagaggacccgattctgtccgacttgtgccgccgcttcattaaccgccagctgtttcaatatgccgaatttaatccgaatgaggaaatgtcggcttattttgaactgaccgctctctttaaagaggcgggaattgatcccaattactatttagtggtcgattcttcatcggatctgccgtatgatttttaccggccgggtgaagaggaggagcgtctgccgattcatctgttaacgcagaacggccagatcaaagagctgtccaggcagtccgccattgtcgaatccatttcgggcaaacgccggacggaccataagctctactatccgatggacctcatttgcgacgattcagaaaaccctgaagcaaaattaaaaatccggcagctgctgggactgacatagaaggattttggtaaagaaggaaaaggagatgtcgggaatttgttgaaagaacatgcaaaactgatgaaggtgttctcggattctggagaaatcatcgggcggaaaaagctgcagaaaatcatttatatcgcgaagaaaatgcagtatcctttctacgaaaaatatgattttcatttttacggcccgtattccgaagaactgacgcttcgaattgaagagctgtgcaatcttgggtttctggatgaggtgaaggaaaaaaagggcggctactttcaataccggtactcgctgacggagacgggagccgagtttttacatcatgcggagcttaagatgccggatatgaagaagtacatcgacagcgtcaacagccgctcatcccggtttctggagctggtgtctacgattttgtattttgacggccttgaagctgaggaaaagaaagagaaagtgtttacgataaaaagcaaacagaaatatacggatgaagaatatgatgaggcgcttcactacatagaagagctgaaacacatttgttaaaggcgatgctttcgtctttttttatgaaaaaaccaggccgcgatgaagcgggcctggttttgtttattgtctcaatttgctgtgcttgtacgaatataaaaagtaaacgatgacgccgatgatcagccagacggcaaaataaagccacgttttcagcggcagattgaccattaaaaacaaacagcagataatggccaaaatcggcagtacgggtacaaaaggcactttaaatccccgtggcagatccttatgggtgcggcgcagaatcagtacggacagactgaccatggcaaatgtcaatagcgcgccgatgtttgagagatccgacagctctttcagatcaacaaaacccgcgatgcatgcgctgatcagtccgatcagccacgtattaaagatcggcgctcccgatttctttccgacaatggtaaagactttcggcagcattccgtctcttgccatcgcaaaagatatacgggtcgccgcataggtatgagcaagaacgacggccatcagtccgatcaccgcaccggcagcgataatgcccgccaccgcgttttgtccgacagtctgcagcacataagacatggcttccggcacattaagctgtgaatacggaaccatacccgtcatgacgagacagacgatgacgtataccaatgtacagatcaccagtgaaccgataataccgatcggcaggttgcgctgcggttttttgacttcttcagccgaagccgaaatcgcgtcaaacccgagaaacgcaaaaaagacggcagaagcccccgtaatgacgcctttaattccaaaaggcataaaaggatgccaattgcccggctttacaaaaaagcttcctgtgatgataaacagcaaaacaattccgatttttacgagaaccattatattattaaaggttttgctctctttagagccgcgtgacagaacgacggcaattaatagagtaatgatgatggcaggaaggttgacgatccccccctggctcggcacgtgcagcagactgtccggcaaaggcatgccgatttcggctaacagattattaaaataacttgaccagccgcttgccaccgctgacgccgtcaccatataaacggataagagcgtccagcccattaaatggccgacaatttctcccatggtggtataagagtaaatataggcgcttccgtaaaccgggagaacagaagcgatttcggcgtaacataatgctgcaaggctgcagacaacggctgcaatgataaaagaaaagattacggaaggcccggcgtttttcgcggctgtaatgcctgtaagaaccatgacgcccgtcccgatgacggcgccgatgcccagtaatgttaaatcaaatccacccatcgttttggcagtctgcctttttctgctttgttcaagcagctgggtgatgtcttttttttgtaggatattccgcaacacgcatccctccatccaaaagcaaaagccaagagggactctttggcttttacccgtgtcacatcttctgtgtaatcgacaatcctgtgttctgtttccccgtctgttccgtttcttttcttttccaatcatattgtctgccgcatccgatcagattatccttaccgtcaaacgcagtcacccttaatgattttacctgaatcgtgtctataaaaccagcattgcataaaaggatatggtaaaaaagagggagacaaaagtctgtgcagggcaggataaaagttgcgggcattccggccggaattttgactttctccgtaaggtatcagtaaaatgtaataaaaaacaaacaaatgatgatggatgcatcttgaaatggggagtttctgcatgaagcacgataacttgcaagcaaatgtactggattacgcgctcacgaaatatttaaagagcacgaaaaagcttgatgaggcgacaattccaaagagtataaacaatatcagaggatttattctgaggattatttaccggcacggcacgtgcacgattaaagatatattgcaggaggtcacattatcgccttccgccacgacaaccgctctcaatcatttagaaaaagaaggattcgtggaaaggtcgagaaacaatgaagaccgccgcacggtatggatgacgctttccgaatcgggaaaaatggcggccatgcaaatgattgaaaaccggcagctgctcattgacgaactgttcgaagcattgacagaggaagaaaagaaaatctttttcagcctggttgaaaaggttgtgaaataagccggcctgacatagcagcgccggccattatcaaggattactccgtatcgctgatccgtttgccggcgacggcgtaatgatcctttctcatttcttcaatcatgacaatgatcttttcttcggctgcgccagtcgtttcttttacggcttcggtcactttttcaaccagattccgtttttgttcatctgtgcggccttcaagcattttaacggttacgagcggcatggtgctgatcctcctttatcgtttcctctctttggaagagagatcacttatagtatactgaatgaaggacaatcttgcatttttaaaaaaaggggattttgacatttggacagatttttatattatccgctggagcttatgccctatgtcgtgattacgctgatcgtggcatttacgatgcatgaactggcgcacgcgtatgtcgcgtatcggttcggagacgataccgcggcgagacagggcagattaacgctcaatccgattaaacatcttgatgttttcggaacgattctaattttggtcgcgggtttcggctgggcccgtccggtgccggtgaaccgccgcgcctttaaaagaccgcggctggcgggagtgctagtttccgtcgccgggcccgtaagcaacctgcttcttgcctttatcggtttctttttgctagtgttgatgcatgcttacggaatggagctgctttctgcattcagcatggggcttgaccgctttttctctatttggattcagctgaatctcgcgctgtgtttattcaacctgctgccgcttcctccgcttgacggctaccggattattgaggatctcgtgccgccgcgggtgcgcgccaaaatgactcagtttgagagctacgggattatcgtgtttctcgtgctgtttgtgacaccggtcggctcctatgtcgtgtggccgctgttaagcgaggggagagactggattctcaaggtatttgccattatatttcaaccgcttttgtaggagggtattttcatggaagaaaaaaagaagaaaacaatcggatttaatattattaaaagtgatccgaccgacggacatggcggttttggcgccgggtcgctgagccttgacaatatttctccggtatttgtcgatgtggaagagaaggaagctttcgtagacatcggcgcaatgcatgcccgcagtgtcgttgaaaaaggcatcaaattcctgccgaacaaagatgaagtgccgaacggaaaaccgtactggctcgtgtgggtcaccatcgacagaaaaaaagaaggcccttattacgcgggtgtgacggcttgtgaaatgaccgtggacagaagtatccgcagaggctataagtcattgccggagcatgtgaatttaatggataaatcaatgaagcgccgcattatcgtggacaaaatggacgccagctcaaagcaggtgcttgctgaatttctgcagaagcatgaccaagggctctgggaacgttcatccgatgaattgaaaacaggtctgcttccgggcgaaaaataatttgtgaactttttgtgaactttataaatatttgcactatttcgcaattgtactgagtaaactgttgatacagaatcaggacatggaaagtcccgagccgaaccaagactcggggtttttcatgtttacgcggaggtttcatcatgttcaccgtctttgacatcgggccttggatcattgaagcagatacggcggaaacgagaaaacaatatgaaaaatcatgggctgatccctgcgattgcgggagctgccggaacttttccgaggcggtgaatctccttcccgccgagaaaacaagattgtttacgcagtttgggattcgtccggctgtctgtcacgatttgggggagcatggaaaggaaaacggcctgcatcattatgcgggcagctatccgattgtcggcatgcttagggaaggctggccgaagtttcacattgagagagcgggagatatccgcttttcgttttctttgcctagtacaacattttttataccgaagggttttcctgaccctattatccatctcgacttttcactcttgctcccatgggtgcttgaggaagacgcggattaagcccggcgcgcaatgcaccgggctcagtcttttttgccgagccacttatcccaccactttttgcgcggagcttctttacgggcggggacgtgttccttttcttttttagacggttccggtccgtagcacacatccgcgggctcagtgcctgcgatgaaatacgtgtaatgctttgcggcgcatccgggtcccgaagtgtagccggaagcggggtcaatatagacgcccgtgacgcccttcggcggtttaagcgctatttccggttctccttcgagcgccttctccataaagtccgcccaaatcgtcttcgcatagcttttttcttctactgaatcaatcgtgctgcttttgtcatagcctgtccacacaccggcggcaagagcccgattaaagccgatcatccagctgtctgcgctggtcgtgcctgatttcccgccgtacgtccgggtcagccggtctgaaatggtgcgtcccgtgacggaagtatagccgtttaaatcctcatcaaacatgcccgtcatcatgctcgccgtcacaaaagcggcttttttatcaagcgtctgctgatgtccgcgcggctgttcatacaagaccttgccggcggtatccgtcacttttgtgataaaggaaggggtgatttgttttcccccgtttgcgagcatcgcataggcattaaccatctcaatcgggcgcacgggttcagttccgagcgccagagacggaaggggctttaaatgttcgctgatgccgaattcctttgccgccgacacgagcttattcatgccgagaaagagatgggtcttcacggcataaatgttgtctgataacgcaagcgcctgaagcagcgtaatcggtttattggcgtagtagccgttgtaattgcttggagaataggtatctccgttgtcgtcaatctggaactctgtggcttcgcttttcatcagcgtgaccggtgtaaagccgctttgaatcgctttgtaatacaaaagcggcttgatcgtggaagccggctgccgtttcgcctgtgtcgcccggtcaaacgggcttttttcgtagtcacgtccgccgagaagcgcaagcacgcgccctgttgccggatcaatcgcggaaaagccgacctgaatgtcagagccggtacggatcgtatgtgccacagtgttttccgcgatccgctgcatgcgcttatcaagcgttgtataaacacgcaatccgctcgttgcgagctgttcgcgcgtcatgccgagctttttctcgagttctttcatcgcatcatcgtaaaaataaggcgccgttttcgccgcggttctgcttttcagcggctgataggcaagcggcgttttcttaatcctttccgccttttcttttgagatcattttttgtccggccatcagacggagaatggtttcctggcgctgtttggccttcttttcactgacatatggcgaatagccggacgggcctttcggtatgcccgccagaagcacggcttccgcatcgttcagatctttggcgtgtttgccgaaatacaggcgggaggcggcttcaattccgtatgcgccgtggccgtaatatatcgtatttacataaccttctaaaatctcgtttttggaatagttctgttcaaggcggatcgtgtaaaatgcttcgttccattttcgtttccatgttttatcatgctcaaggtagagatttctcgcgtattgctgggtgatggtgctggcgccctgaaccttggccattgcctttatgtcagccagcgcggcggcggccatccgccggtaatcaaaaccgtggtgattgtaaaagttttgatcctccaccgcaatcgcggcctgcaccgctgtcggattgatatcttttaaccgaacccagtagcgcttttccccgaaatcggtctcacctagctttgagccgtcatttgcataaagaatcgtagactgaggaacccggacggagggggcgccctgccatttcgctgcaagaagaacggatgtgaagcagacgccggccagcattccgccgatcagtgtcagaaagatgcaggcgcggatgattttgaacgtgattctgagctgttttccagatactttatccacttttgggaaccccctttttcatgattctattattatgtgaaaaaagggggttttttaaacatatcaaaccggacacttctttactttttcccctccatcctctatactttttccttaggtgaaaatgagattttaaccggaataaaagcgatacagacgcttacaataaatgaaataagccttgaaagggagatgacaattgagcgagctttggtatacggagaagcagacgaagaatttcggcattacattaaaggtgaaacaaacattacatacggaacagacggaatttcagcatctggaaatggtggagacagaagaattcggcaacatgctgttcttagacggaatggtcatgacatctgaaaaagacgaattcgtctatcatgaaatggttgcgcacgtcccgttatttacgcacccgaatccggaaaacgttctcgttgtcggcggcggagacggcggtgtcatcagagagattctgaagcacccaagcgtaaaaaaagcgacgcttgtcgacattgacggcaaggttattgaatactctaaaaaattccttccgtccattgcgggcaagcttgatgatccgcgcgtcgacgtgagagtcgatgacggtttcatgcacatcgcgaaatcagaaaatgagtatgacgtcatcatggttgattcaacagaaccggtcggaccggccgtcaatctgttctcaaaaggcttctatgccggaatttccaaggcgttaaaagaagacggcatcttcgtcgcgcagacggacaacccgtggtttacaccggaactgattacaaacgtacagcgtgacgtgaaagaaatcttcccgatcacccgtctgtatacggctaatatcccgacgtacccgagcggcctgtggacatttacgatcggttctaaaaagtacgatccgcttgaagtagaggacagccgtttcttcgacatcgacacgaagtattacacgaaagagcttcacaaagcggcatttgttcttccgaaatttgtgagcgacttaatcaaataaaaacgtacggcgcaggagcgaatcttgcgcttttttacaggaaagcgagggaattattgatgagatttgatgaagcatattcaggaaaagtatttatcgcgagccgccccgactggaaagaggcggacgccatcctttacggcatgccgatggattggacggtcagctaccgtcccggttcacgattcggcccggggagaatccgcgaggtgtctatcggtcttgaagaatacagcccgtacctcgaccgtgacttggctgatttgaatttctttgacgccggagacattccgcttccgttcggcaatccgcaaagaagccttgatatgattgaagaatacgtggacggcatcctagaaaaaggcaagttcccgctcggcatgggaggggagcaccttgtatcatggcctgtcataaaagccatgtataagaagtttccggatcttgccatcattcattttgacgcgcacaccgacctgcgcacggattatgaaggcgaaccgctttcccactctactccgatccgcaaagcggccgagctcatcgggccgcaaaacgtattttcattcggcatccgctccggaatgaaggaagaatttgaatgggcgaaagaaaacggcatgcacatttctaagtttgaagtgcttgagccgctgaaaaaagtgctgccgcagcttgcgggacgcccggtttatgtcacgatcgatatcgacgttcttgaccccgctcatgcgccgggaacgggcacggttgacgcgggaggcatcacgtctaaagaattgctcgcgtccatccatgaaatcgcgcgctcagaggtcagcgtaaaaggcgccgacctcgtagaagtggcaccggtctatgaccactcagaacaaaccgcaaacacggcaagcaagatgatccgtgaaatgctgcttgggtttgtgaaatagaaagaatttcccccgcttgaaacatggcgggggatttttatattgtatataaactacttagaagttagtaaaagaaatatattattttactattaataattgatgttattgataaaaattatataatagggtattatttagtaaatacatctttagaaaggaagttagaatgaaaacagcagtagaaaatgaattggaattaaaaaagattgaaatttcagtaattaaactgataattgctgaaaagcctaataaagagatcgctaagtcattaaactactcgcagcgtaatgtcgaatatatcatagccggtctttgtaaaaagtggaatgtaagtactagagtcggtattgtttcggaagcatataaaaggaattgtatacagtgaacgaaatgaaagaaaaacccctattgagggggtttatttatatatgctaaaaaaacattctatacaggaatgccgtaaaaataaaaactgagattgtcaggtagttcaaatttgttctccatttcagaagaataaacaaaagaaataagtatgcaatattgaacaaatcaaagatagaaaaaatcaaatgattacttgtgaaaaataaactagtgtttggatgttgtgcgaaaatatttttgaatgatataagaaaaaacttaatcgcgaccgggatgttagaaaacataaatagggaataaaaagttttgatcttaatctgagcgccaagaaaatttataatgagaaataatacgaatccttcaaaaatgaccccgaacattaaaagaaacagtgcggctattgcaatgatgtaatctaaatgttttacttgctcaacaacttgtatagggatgtttttgggaattaaacttttcataaaaggtaaaagggaacttaaataaaaagctaacccgataatataaaacaaaaacgaggacaaaaaattaatgtttcgttccttaaatgaagataattcaatttgcataatcctaagaggctccttttataaagataggtgtaataaatgtttctaacatagctgctatcattaaaccgagaaatataataccaatatatttaaaagtgaatttcaaatttattttgaggagtaataaatctaaagttaatttcattcctacagaggctgcaagaagcaataccggcacttcaattattccatggggtataacaagcagtaaaaggtttaaattgtctttaatgtttcctatcgcatttcctaaaattaatccattaataattaaaacagcaaccgtgccaagcgacagcgttaacgggcctaaaaaaacaagcagactcgctactttaatattattaaagaaaatctgaaaaaaatccggacggatatttcgatttagattatttacatttgaagcggaatctgtataaatatatgctgtaaataaagcaattaaaaataagatcagacagagtatgtacaatttgactaaaacattctttttaaacaatgtattttcatccattcgttaaagggactgccagggatattgaatttaatgttttatattatgctgctgctgtacttgctgcagccaattgttctaaaacggccaatggcaagcctgcaccaagagatcctaaaacagtaatgatagccagaactgatcccgttgcggtgatagcactgacaatccaactaggagcgataattccagctctgtttaaaatatcgataacatccatgcttaaatgattatgtttcatactgaaaagagcgagaacaatgattcctgatgctactaatgtaaaaatcgctttactattttgtgtttttaaaagtagattcattttttcctccaattttttcaatatccccagcaagttaaataataaaatatattggaatctatttgaattgcggatttccgaaaaaataatagttaagaggtgaaatccgtaaaagtatctgctggcttatttcgtacaaagaaagccggaccatatgtatgatccggctttctttggtactgaaacattatacttttttttcaaaaataatatcaaaataatcagctgccccatagcctgaaatagcaggagcaaatatttgaaccagctttcacccttgctgcgaatacttttcaataatttatttatagtcttctttaggctttcctttccatcggtttacttctgcttttatgaacttgtattcgtacattgctgtataatcctccggaagtgtattggaatcgttaccttgtttttcgattttgataaacttgaatccataaatagagcgcgcagcctattaaaagaatcggaaattgccatcctgtatttccgtttttaaaataatctattaatgaccatatcagtaaagcgacagtataaaaactaaatgctattctggcggctgtacccgattggtgtttttgcatctcatccattttcttcataagaaccgctcccttaattttttttggcgttatagttgaatactttatctattcccgtatttaaagcgtgagctatcgaaaaagccagacttaaagtcgggtcatatttattattttcaattgcattgatggtttgcctggtcacattgcagagcttagccagatcattttgtgaaatatcagctgctgttctaagtttttttatattgttatccactaaaaccctccttaacttattttgttttttattttaaattttcaaatttatatatatttattttaaataatatatgtataagtgtcaaatactttttacacatttgagttctaaggtatgttttttgtttttgtaaattagttgtttatataaaaaacggcttgcagtttaacctgcaagcctaaaagtaattatcatttaaatcatagctctttgtgctacttcgaattggtgtgaaggtgtattcgtcatatctgctgttataaaaactgaggttacagctaagcaagtgagtaagaccttatacttcagcttcataaaaagttacccccccttgaatatgctgtcttgcttcttcaacttttaaaaagtatgttgaagcttttttataatcttcaagtttgtgataatatttagctgcatcaagagcaaaatcttctatatctgcatacatcatcttactttccaaaaagtcaaaactccttttcattgcatcctcatcaggtccgttcacatacaaagattttaaaaattcgaattcatgtaaataaactgaatctgctgactcttcggaatagataactccttttttatgatactcgagcgctttgtcgtatctttctaatttataatgaatctgtgtcattaaaaaatatgcttggggcaaagaaggggtcattttagcactttcaaaaacatcaatggctttttcaacataagttatagctgcttcatagtcgttcaggctttgtttgcaaagtgcgatgttatacagcgtcctgcccattaattgaggctgtttttctgtttctgccaaagaaaaagccttttgaaagtgagtaattgcccgatcatatagttttaaatccaggaaatttgctccgaataaggattggcattgtatgagcctgatatcgtatgacgactgagctttatatatttcatatgcctgccttgcgtaatcggtagatacatacgtttgtttcaaatagtagtagacttcagacatcttgaaaaagtactcggctttatcaatagtatccttaataaatgagagtttcgtctcagcctttttaaaaaattttatagccgacaaatattcccgctgatccagctcatacatcccccggaaaaaattaaaataataatcaagccgtccggtcagccgggcctgctttttatcaatatccgcgagcagatccgatagtctcggctgttcttctatccgctgcgattccagcggttcgaggtattcgagcatcagattgtggcggaattccatgagagaatagtacagatgaagatcctgatcttcttccaggcctgcaagctcttctttgatttctctccgcaagtactcggcgtccgggatgctgaaccttcgaatgtacatataccattcgttgattttttctccaaccgctgaagacgataaaacactcgccactattccgaatccctcccttccacgttatgtatatgacatattttatcattttcattcggaaggatagcgcaaaaataccgcaaacttttcccctttgacaaagccgtccgccgaaggaaccgcatttatcccgcagcctaggatttccggttttttcattttccttaaaaatcatgtttatcttcaaaaccaatcagcaaagatggtaagataggaggaagcggttgaactttttcccttgaaaacttatactattcaggttaagcgggatgatgaaaaggaagtgtcagcatgagacaggagacaccagtagccattcatgtgcaatcattcattcataacggctccgaagaagagtcggttgaatttacatcgagtggattctattacgtgagaaacggcaaaacgtatctttcctatcacgaagagcatgatttgggcaagattaaaacggtcgtcaagattacagaaaaagagattctcgtaatgagatcgggcgccatccaaatgaaacagcggttcattccgggggcatcgacactcactcaatataaactgccgttcggacaaatggagctccgtacggaaacgaaaaacattcaatctgatgtcggcggttcggaaggctccgtcaaactgacatataacatgactgtaggcgaaaaccaagaacatgtacataacatgacgatccaatataaggaggaaacaaaggcatgaatattgcggaacaaatgaaggacgtgctgaaggaagagatcaaagcggccgttctgaaagcgggcctggcggaagaaagccagattccaagcgtactgttagaaacgccgaaagacaaaacacacggtgattattccacaaacatggcgatgcagctggcgagaatcgcaaaaaaagcgccgcgccaaatcgctgaggagatcgtggcgtcatttgataaaggcaaagcttccattgaaaagatggatattgcggggcccggctttatcaacttttacatgaacaacagctacttaacaaaactgattccgtccgtgcttgaagcgggtgaacattacggagagacaaacatcggacaaggcgaaaagattcaggtcgaattcgtatcggccaacccgacgggagatcttcacttaggccatgcgcgcggcgcggcggtaggtgacgcgctgtgcagcgtgctttctaaagcgggctatgatgtgagccgtgaatactatattaatgatgcgggcaaccagattaacaacctggcgctttccgttgaagtccgttattttgaagcgctcggcctcgagaaaccgatgccggaagacggttaccgcggcgaggatattatagcaatcgggaaaaagcttgccgaagatttcggcgaccgtttcgtacatgaagaggagagcgaacgtcaggcgtttttccgtgaatacggcttaaagtacgagcttgataaacttcgctccgacctggaaaacttccgcgtgccgtttgacgtatggtattctgaaacgtcactgtacgaaaacggaaaaattgatcaggcgctcgaggcgcttcgcgaaaagggccatgtatacgaagaggacggcgcgacatggttccgctccacaacgttcggcgacgataaagaccgtgtgctgatcaaaaaagacggctcatacacttatctgctgccggatatcgcataccataaagacaaacttgaccgcggattcgacaagctcatcaatgtatggggcgcggatcaccacgggtatattccgcgtatgaaagcggcgattgaagcgctcggttacaagaaaggcacattggaagttgagatcattcagctcgttcatttatacaaaaacggcgaaaaaatgaagatgagcaaacgtacggggaaagccgtaacgatgcgcgacctgattgaagaagtcggcttggatgccgtgcgttatttcttcgcgatgcgcagcgctgatacgcatatggattttgacttggatcttgccgtatccacatctaatgaaaaccctgtgtattatgcgcaatacgcacatgcacgtatttgcagcatgcttcgccaaggggaggagcagggacttaaaccggcggcagatcttgatttcagccatattcaatcagaaaaagaatatgacctgctgaaaacaatcggcggcttccctgaagcagtggcagaagcggcagaaaaacgcattcctcaccgtgtcacaaactatatttatgatctggcttccgctctgcacagcttctacaatgcggagaaagtcatcgatccggaaaataaagagaagagccgcgcgcgtctcgctttaatgaaggcgacgcaaattacgctgaacaatgcgcttcagctgatcggcgtatccgctccggaaaaaatgtaatgatgatcaaaggacaaagtcttcgggctttgttcttttttttgcatataaagcgtgtgatgtaattcacaatccagcacactgagtttttgtatgataagactgatattgaatcagtgaaaggggcaagccgaatgatcaatcgtcaacatattcaattatcgctgcagtctttaagcttagtggcagggtttatggtgtgggtgctgatttcatcgctcatttctcaaatgacatcagatattcatttaagcaaaggcgagatttcattggtgacggcgattcccgttattctcggatcgcttctccgtattcctttaggatatttaacgaacaggtatggcgcgcggctgatgtttatgatcagcttcatcctgcttttgtttcccgtattttggatcagtatcgcggattctttatttgatttaatcacgggcggctttttcttagggatcggcggagcggtattctccatcggagtgacgtccctcccgaaatattatccgaaagaaaagcacggtgtcgtcaatgggatttacggtgccggaaacatcgggaccgccgttactacctttgcggcgccggttatcgctcaagccgcgggatggaaagcaaccgtgcagatgtatcttgttttgctggctgttttcgcattactgcacgttttgttcggcgaccggcatgagaagaaagtcaaagtttccataaagacacaaatgaaagccgtttaccgaaatcatgtgctgtggatgttgagcctgttttattttattacgttcggcgcctttgtcgcctttaccatctatcttccgaattttttggttgagcattttgggctgagccctgcggacgccggtctgcggacggccggctttattgcggtctctacgctgctcaggcctgtgggagggtttcttgcagataaactgagcccgctccgcattctgatgttcgttttcgcagggcttacgctgtcaggcgtcatgctgtcattctccccggcgatcggcctttatgcgttcggatcgctgacggtggcagtctgctcagggattggaaacgggacggtatttaaactggtgcctttctatttttcgaagcaagctgggattgccaacggtattgtgtctgccatgggcggactgggcggttttttccctccgctgattctggcaagtgtatttcaggcaacgggtcaatacgcgatcgggtttatggcgctttcagaggttgcgttagccagctttgtccttgtgatctggatgtattggcaggaaagaatgaaaacacatacggagagaaacagtcatagccttgattcataatgatccattcacaagattgttagttttttctgggtgagtgcaaatcaagtcacgttacaatatacatacgcaacgtgactttcttcgaggtgagctcatgaatattctctctgtccgaaaatctgataaagaacttctttcccgcgaactgcatgaattgctggaatcgatcagtacgaaaaggaaaatgaaaaaacacacgtatttgtttcaagaaggaatggatgcagaagagctttatctgattcaatcaggactcattgaaatcggcaagctgacatctgacggaaaagacctgacacttagaatctgccaaaaacacgatattgtcggagaattgacgctattcacagatgagccgagatatatgctcagtgcgaaagtgttagaggacggggaggtgctcgtcattaataaaaacaggctggaaaaggaattggtccaaaacggtgttttgacgtttgaatttatgaaatggatgagcacccatctgcgaaaaatccagtctaagatcagggatctgcttcttcacggcaaaaaaggggcgctctattccacccttatccgcttatcaaacagctacggggtggaacgaagcgacgggattctgattaacattgtgctgacaaatcaggatttggctaagttttgcgcggcggcaagggagagcgtcaaccgcatgctgggagacctccgcaaacaaggggttatttcgatagacgaaaccggaaaaattattttgcacaagcgggactatttacgatgcgagatcgagtgtgaaaattgtccgcttgagatctgcaatattgactgaaaaaacaagggcagccggtgtccttgtttttcagcttgtgatacatatacacatgacggcgaaaaagaagccggcatttacgatttccagaatgccgatcgttttcaccggccagtctcttccgtgaaaaaaccaggcccgcagactgcttgggataaaagcgagaaacgcccagcctgccccgagaagagccgataaaaaggggagcaagaggtgatatccccacgaccagtaagcaaaccttctgttttttctctcccgtatgaccgatttcacataaaaagaactcccgacaaaaaataaagcggattgcaagaatagaaaccaagcccagccgtcaaggattcccgttcccagccagcagctcgcaagcccgcctgaacaaaagaacaagactcccgcaatatcattcgtgagcgcccgttcgttttttcggcgggcataatgcgtatgtatgagaaacagcggcaataaaaaaacgccgatccagacgagctgcggcttatgaaagacagaaatgatcaaaaagcagcaggccggaaaaccgtaataccatatccacttttgataaggctgaagctgtttctttttcaaagcgagcgaaacgggataaaccgtcaagtaaaggaacagccagcccagaaagagcggaatatgccagaaaaccgggcctcccttgaccatgccgagtaaaaatggaatcagcagcatcgcccatgcgccgtgctgcttcggaatcatcgctttcatcgaaaccctcctttttatttcattataagtgcaaacactctcctgataagtgactttcatcatacaagctgtgaaatacatcactgccgcgcgggctcaatcgggctacactaaagctatcaatagcacaggaggctttcctatgaatcagtgtgactatttattatttctgaaacaacttcctatgtttaatgaagtgcctctgtccattgtcgaaaccttgctgaaaaacgggacgtttatccgcggctcatctgaccaatctccatcctttcttcattcacaatccgtttatattgtattaaaaggcaatatccgttttacggacagcaggctccctgaagggtcgcaaaccgttgcgctgtgggaaaaaggcgatgtgtttccgattgatgaaaaaggcgggctctctttatcgccttttatctcagtcaatgcctcaccggatattctggtactccatattccatattctatatttaagcaaatgatgtcttaccatccgcggctgcaaatgaactttttggcgatgcttcagcaaaatgtcttctgttcctatcagttgtttttgcggtatctgcatacatcactggatgaaaacgccgaacccggttcttaaacagaaccggtttttttgatgacgcgggcgtcctcatatcgtttaaaaatccttcctgctgctctgtgtgaacgttttgtgaaaaaagcagagtgtgtgacttagttcacaaggtgatgcgccgtctctgtttatagtgtacatagcatcacctgactcggaaggagtgaacgatcatgaagaaaaagaaaatgagtccgttgctcaggagattaaactatttttctcctatcgaacatcattcaaataaacatagccaaacgacaagcgaagatcgtgattgggagaatgtatacagaaacagatggcagtacgacaaagtcgttcgctccacccacggcgtcaactgcacgggttcttgcagctggaatatttatgtgaaaaacggaattgtcacgtgggaaggacaaaacttgaattatccatcaacaggaccggatatgcctgatttcgaaccgagaggctgtccgcggggggccagtttttcatggtacatctacagcccgctccgtgtgaaatatccatatgtgcgaggtgtgctgatcaatttgtggcgggaagcattgcagacgcatcaaaatccgctggatgcctggaaatcgatcgttgaaaaccctgaaaaagcgaagtcctataaacaggcaagagggaaaggcggctttgtccgcgcggaatggccggaagtgctgaagctgatttcagcctctctgctgtatacagtgatgaaatacgggcctgaccggaatgtcggtttttctccgatcccggcgatgtccatgatcagccacgcgtcaggttcgcgattcatgtctttaatcggcggcccaatgctcagtttttatgactggtatgcggatctcccgccggcgtccccgcaaatttggggtgaccagacggacgttccggaaagcagtgattggtacaattcaggctacatcatcacatggggttccaacgttccgttaacgagaacgcctgacgcgcactttttggcggaggcccgctataaaggggccaaggtgatttcaatcagtcccgattttgcggaatcctcaaagtttgcggatgactggctcagtatccgccaagggactgacggagccctggcgatggcgatgggtcacgtcattctgcaggaattttacgtgaatcaagagacggaacgtttcatggaatacgcgaagcaatacacggattttccattcctcgtcaccttatcaaaagaaaatggcgtatacacagcgggacggtttctgcatgcgaaggatatcggacggcagacaaagcatgatcaatggaagccggcggtctggaatgaacagacaggtgcgtttgccataccgcaaggaacaatgggctcccgctgggacgggcagcagaaatggaatctgcacatgatcgatgaagacaccggggaacagatcgagccccgtctctccgtgctcggaatagaggacgaaatcagtacggtgcgcattccgtatttttcaaatgacggaaacaaagtgcttgagcggaatcttcctattaaaaaactggaactgaacggtgaagaggtgtgtgtcacgactgtatttgacttgatattggccaactacggcgtgaaccggggcatcggcggacaatcagccgcatcttatgatgatccccgtccgttcacacctgcctggcaggaacagatcacgggaattaaaagagaagccgttatacagattgccagggagtttgcccaaaatgcgattgatacagacggcagatcgatgattatcgtaggggcgggaatcaaccactggttcaactccgacacgatttaccgcgcggtgttaaatcttgttttattggtaggcgcccaaggcgtaaacggcggaggctgggctcattatgtcggtcaggaaaagctccgtcctgctgaagggtggcagacgatcgcaaccgcaaaggactgggaaggcgtgcctaaactgcaaaacggcacctcatttttctactttgcgacagaccagtggcgttacgaagaccagccgatcagtgacttggcttcaccgatcgcttcttcatcccgctacaagcatcacgccgattacaatgtgctggcggcgcgattagggtggctgccgtcctacccgacattcaatcaaaacggcattgatctgtacaaagaagctgagaaggcgggggcggcgacacctgaagacgtaggtgcgtacgtggcctcacagcttcaggagaaaaaactgaaattcgcgattgaagacccggacaatgaagtgaatttcccaaggaatctctttgtatggcgggcaaatctgatctcaagctcaggaaaagggcatgaatattttcttaagcatctgctggggacgacgaacggtttgatgaatgacgacagcgacagcatccgccctgaagaaatcaaatggcgggagcaggcgccggaaggcaagctcgacttgttaatcaatctcgactttcgaatggccggtacggcgctgtattccgatatcgtgctgccggcagcgacatggtatgaaaaacacgatctcagcagcacggatatgcacccgttcattcatccattcgctccggcgatctcggcgccgtgggaatcgaggtcagactgggatattttcaaagcactgtcaaaagccgtttccgacctggcggaagaagtcgatatggagctggtgaaagaggtagtcgcgacgccgctcctccacgacacgatgcaggaattggcccagccgttcggaaaaatcaatgactggagcaagggcgaatgtgaagccattccgggaaaaacgatgccgaatatccaagtcgctgaacgggattacaaacacatttttcataaaatgaccgcgctcggccctcatacggctttaaaaccgagcggaacaaaagggatgagctggtcgattgcggatgaatatgaatcactcaaaaagagactgggagaaaccgattcagacggcgttgccaaaggatgcccgaatataagtgaagcaaagcaggcggcagaagcgattttaaccctgtcgtccacctcaaatggaaaggtcgccgtaaaagcatgggaatcgcttgaaaacatcacaaacctgaagctgaaagacctggcggaagaacgcgaggaagaatgctttacgttcgagcaaattacagcccagccgaaaacggtcatcacgtctccggcctttaccggctcagaaaaaggagggcgcaggtactcgccgtttacgacgaatgtggaaaaattaatcccgtggaggacactgaccggcagacaatcctattatgtcgatcatgaactgatgatggaattcggtgaaacgatggcgacatttaaaccgatcctccagcaccgtccgttcctgagcaagcggcctgatcaagagggcaaagagatcgttcttaattatttgacgccgcataataaatggtccgtccacagcatgtattttgattccctgccgatgctgacgctgttccggggcgggccgaccgtgtggatgaataaagatgacgcaaaggacacggatatcaaagacaacgattggattgaatgcttcaaccgaaacggcgttgtcgtggcgagagcggttttgtctcaccggattcctaaaggaatggcgtttatgcaccatgcccaggaccgccacatcaacgtgcccggcacaaaactgacgaataaccgcggaggcacccataacagcccgacaaggattcacgtcaagccgacccagatgatcgggggctacgcacagctcagctacggctttaactattacggtccgacggggaatcagcgcgatctgaatgtcgtcatccgcaagctgaaggaggtcgattggcttgaagattaaagcgcagatcggaatggtcatgaacttggataaatgcatcggctgccacacgtgcagcgtcacctgtaaaaacacgtggacaaaccgttccggtgcggaatatatgtacttcaataatgttgaaacaaagcccggtatcggctacccgaagcaatgggaggaccaggacaaatataaaggcggctggacgttgaaaaaaggaaagcttgaactgaaatcaggcccgaaaacaaaccggcttgcaggccttttctataacccgaaccagccgacgattgatgattactatgaaccttggaactatgattatgaaacattaacaaacagcccgcagaaaaagcaccagccggtggcgcggccgaaatcgtccttgacgggcgattttatgaatatcgaatggggcccgaactgggaggatgatctcgctggcggccacattacgggtcttgaagatccaaacgtgcaaaagatggaggaatcgatcaaaacagaattcgatgaagtctttatgatgtatctgccgcgtatttgtgagcactgcatcaatccggcgtgcgtgtcctcctgcccgtccggcgccatgtacaaacgcgaggaagacggcatcgttctcgttgatcaaaacgcatgccgttcatggagatattgcgtctcatcctgtccttataaaaaagtctattttaactggcaaacgaacaaagcggaaaaatgcacactctgctttccgcgcttggaggcggggctgccgaccatctgctccgaaacgtgtgtaggcagaatccgctatctcggcgtcatgctgtacgacgcggacaaagtggaggaagcggcctccattgaaaatgaaaaggatctctaccattcccaattagacgtttttcttgatccgaatgatcctgaagttgccaaactggcaaaagaacaaggcatcccggctgaatggatagaggccgcgcagcaatcgccgatctacaaaatgatcatcgattggaagattgcgctgccgcttcatcctgagtaccgcacactgccgatggtttggtacattccgccgctgagcccgattatgaatctctttgaaggaaaaggcagccggcaaacggcggaagatatttttccggctatcgaccaaatgagaattccgattgactatttggcccagttattaacagccggtgatacggatcatattcggtcaacgttaaagaaaatgtctgtcatgcgccagtatatgagagcagtccagacgaataaatccatcgacccggcactgatctccagtgtcggcttaacagaaaagcaaattgaagacatgtatcggctgctggcgatcgccaaatatgatgaccgctttgtgatcccgagcagccatcgagaagaagtgtctgatttatacgctgaacaaggaagctgcggcttgtcattttcaggcggccccggctcttgtttctaacttttgataaatgaggtggaacaagatgaacaccacagaccggcaaatgacattctccgctctttccattcttctctcttatccggatgaagagtggagagccgggcttcccgattggaaggctcttatccatgaaatcggcattcagcaaatccgtgagaaactgctgcactttttagaggcggcagccggcttttctccgcaagcgctgattgaacactatgtgtatacgttcgacttcgggaaaaaaacgaatatgtacgtcacctactttaactcaggcgagcaaagggagcgcggaattgaactgctgcatttaaaaaacacctaccagcaatccggtttcctgccgacagagaaagaattgcctgattatctgccgctgatgctggaattcgccgcggttgcggagattgaagcggcgagaagcgtgtttgagaaatacctgtccaatgtgagggagctggcttcccgcctcgaaaaaaatgacagcctctatgctgagctgctgcacgtgctgcaggccgcgctggaaagcatcggtgtacgtgaaagcactgaagaaggggctgctcaggcatgagcgggcagatcctgtgggggattatgccgtacatggtattgacgatctttatcggcgggcatatttaccgctatcagcatgaccagtttggctggacggcgaaatcaagcgagctgttagaaaagaaaaaacttgcggcgggcagcacactttttcactggggactgctgttcgttgtcggcggacatgtcatgggaattctgatcccggaaggcgtgtatactgtactgggcatttcagagcatacgtatcacaaaatggcgatcggcgcaggcctgccggctgggatcgcggcttgtgccggactagtgatcctgacatacagaaggctgtttgacaaaagaatccgcaaaaccagctcgccatcggatatcctgacgcttattctgctgctgttcatgatgctgtcgggcgttgcggccacgtttctcaacattgactcgaaaggatttgattacagggcaacagtcgggccgtggttcagggaaattgttttgttccggcctgacgcttctttgatggagagtgtcccgctatggtttaagtttcatatcatcatagggtacgtcgtttttatcctttggccgtttacaagattggttcacgtgttcagcctgcccctcaagtatttgacccgcagctatgttgtctatcggaaacgcacgtaaaaatccccctgcaagagggggatttttttatggtgaaaaaataaaaacataagatattttctgccaaggtaatggctgggcggcggggattcctgttatgttttatgtggaaataatatcaacaaaaggagagtgaagaatgaagcggattttcctcattttagccgcctgtctgatgacaagcgccggcgtcctgacactcagacattctcatgtattaaccggcggcacagcgggactgtcactaagcctgtcgtacttgtttcattcctcatttgcgattatcttctttctgatcaatatcccgttttatatattttctctcatcagaatgggaatcaaattcactctatccaccgtttttgcagtcactgtgctgactctgtttaccggcgcggatcactggctgccgccggtctctgtttcaccgcttgccggggcgatttgcggcggggcgctgatcgggttcggcctgtcgctcatgttttatcatcaggcatcgctcggcggcgccaatatcctcgctttatttctgcaaaagcgctgcggatggaatccgggtgccgttaatttcctcttcgattttggcgtcgtgctggccggcattttttccgtcggattgctgaaagggctcttctccttagtgtcgatagcggtcaccggtctgatcatcggcatcttcaaaaataaaatcaaaggcagctgctcgctcaatccggcattgcttcagaacatcacaaccggccagtcacaggaagtgtcatcataatcctttccgctcgtgcggagaggatttttcatatgtttacaggccggaaaacagagggtatacagagatatcggatcagatgggagagagtcgggatgctgaaaaggagactggaattttgctttttatatatgatgcttatcggagcatatgtcatatggttttttccggtttccaggcttgagttttacggagggttgctttgctatgcaagcattattttgttcagcatctattcgttaattcttgaaaaccgcacctctcagcacacgctgttatggattcatattcttgtgttttttccgatcgccgggtacttattttaccttttttccggccagctttatgaaaaaggcaagctgttcaggtcgaaacggacatacaaccgggaaaagctgagaacgatatttgatatggaacagacgcccgatctgtccgggctgaaaggaaatcagaagcgtttctttcaatattcaatcaaggcgtctcatatgaatatcaatacaaaaagcaggctgaaggtgctcaaaaacggggatgaaacatttccggagctgtttgaagcgctccggtcggcagcatcatttatacatattgagtattacatgttcaaatcagacatgcttgggcacaagatgatggacattatgatggaaaaagcgcgtcaaggcgtggaagtgcggtttttgttcgacgcggccggcagcctgaagctggccggaaaagacattaaaaaactgaaacgcgcgggcgtgaacatcgtcccgtttctgccgctgaaatacggttttttcaaccaaaagttcaatttcagaaatcaccgcaagatcgtcatcgttgacgggaaaaccggttttgtcggcgggctgaatgtcggcaaggagtatatcggcaaagaccaaagtgtcggtttttggcgggacacccatatgaaagtcgaaggagaaatcgttcagacgctccacagcatttttatgcttgattgggaatacgtttcggatgaggtgctgattgatcagaaagcatacagccgcccggtccctgcagaaagcggcggcgtctatcaagtcgttccgacgggccccgatatgaaggagcggatgagcgatctgtattatgccatgatagcggcggccgaatcatctgtatggatcgcgacgccttatttcgtgccgaatgagccgatccgcacagcgctaaaggaggctgctgccagaggcgtccgggtgcgagtcatggtgccggaaaccaatgacggatttttaacccagtacgcgacgagatcgtatttccccgagcttcttcgcgaaggaatcgaagtctattcctatcaaaaaggctttatgcatcaaaaggtgctcatcactgacggaaacctcgcctctgtcgggacggcgaacatggacatgagaagctttcagctgaactttgaggtcaatgtcttttttacagatcaaaaggcgatcaaagatcttgaagcgcattatctggaggatatgagagagtctgagaaaatcagccccgtccgtttctataagcgcacattatgggaaagaacgaaggaatccttcgcgcggttattttccggcgttttataaaaaacgcttttaaaactccttgtgtatagtataattgagaaatattatcattaggaacgaggcacaaggaggacggaaacgtgctgcgacaatttttttcttattataaaccgtacaagaagctgttttttctcgacttcttttctgccatcgccggcggattgatggagctgagttttcctctgattgttaattactttatcgatacattgctcccggggcgggattggcgtctgattattttgacttccgctgctttattcggagtctacgccctcagctcggcgcttcagtatgttgtgacgtattggggccatatgctcggcattaacattgaaaccgatatgcgtaaaaagctttttgaccatctgcaaaagctttcgttcaaattttacgataacaacaaaacgggcagtttaatgtccaagctcaccaatgatttgatgtatatcggagaaaccgcccaccacgggcctgaagacctgtttatcgcggtcatgacgattttgggcgcgttcggtgtgatgctgttcattaactggcagctcgcgctgttgacctttatcattatgccggtcgtcatttggcttgctttgtatttcaataaaaaaatgacctctgcgtttacaaaactgaacaaagacgtcggagacttcagcgcgagggtcgaaaacaatatcggcggcatccgtcttgttcaggctttcagcaatgaagcgtttgaaacgcagcggtttgacgtgaacaatcagcgtttccgcaaaacaaagctgacgtcatataaaatcatggcgaaaaacggctcgatcagttacatgctgacaagattcgtcacgctgttcgtcctgttgtgcgggacatggttcgtgatccgcggatcgttatcttacggggaattcgtcgcttttgtgctgctgacgaacgttctgttccgtccgattgataaaatcaacgcaattattgagctgtatccgagaggcatagccggttttaaaagctttatagaaataatggaaacggagcctgatatcaaggacgccccgaacgcgagacatgtgtccggtttaaaagggaatatccgttatgatggtgtgtcattcggttacgaagaaaacagcccggttctgtcgggaatcaatttgtccattcatgcaggggagacagtcgcattcgttgggccttcgggagccggaaaatcaacgctgacaagtctgctgccgcgtttttatgatccgtctgaaggcgtgatttccatcgatggaattgatattaaggacatgacgctgtcatcattgcgcggacaaatcggcgtcgtccagcaggatgtctttctgttttccggcacattgcgggaaaacattgcgtacgggcggctcgatgcgtctgaggaagaaatccggcaggccgtccgccaggcgcatttagaggagctggtaaacgggtatcccgacggtttaaacacggtgatcggcgagcgcggcgtgaagctgtcaggcgggcagaagcagcggctttccatcgccagaatgtttttgaaaaacccgtcgatcttaattttagacgaggctacatcagccctcgatacagaaacggaagccgccattcaaaaatcgctgcaagagctgtctgaaggacgcacgacgcttgtgatcgcccatcggctggctacgattaaggatgcggacaggatcgtcgtcgtcacgaaagaaggcatcgctgaacaaggtcatcataaggaactgctggcatccggcggcatataccagagactccatcaggcccaattcggcgagctgatacatgaataatggaaaaaggatagacgagcgggggccgggcagcctcctgtctatccttttttttatgtagtccgtatttaatgggcttctttttgcgcaggttcgatgatatgtttgaaacggtcaacaagctgcaccgctttctttccttccactacaattaaatattcttgttctttatgagccattctgaacgtttccagctcaatgatatctttgattttgcacattgtttttttagagtagatatacagctcgtggcctcccgtgtggcaaagctgataaagctgaagcatgtttcttaaagtgaacttcttagcggctattttcaaagatgtaatgtttttcatgtgttttctcctccgtctgatggtctgttatttcggaaattccccatatgaacgggtgataaacctggttatgccttccacctcagcactccgcccgccaggcgtttaactccgcggatggcgcttaattcttcgacgagccggagcagcgcccggtctttctctttcgcctcaatcataaaatcgatgcccgcatcccattgtctgaaccgctccagcaccggcagaataaaattcgcgtccacatagtccgcatgactgcgtacggctgattctgattttggcgaggagagatggaccttcggctttaagccgatccgctgccatgttttgatcatccgcggaagaatgtcatctaaatcagcgtcatcggccggattggcgtaaaaatggtgataatcaaacacaaacggaatgccttcttgctcacatacactgagtgtttcctcggacgtatatgttttatcatcgttttctaaagtcatccgctgtttgatgacttcgggaagttctttcagattcacgcggaaacggccaagcgcgctttgtttgtcaccgtaagcgcctccgacatggatgttgatgacggaacggtccgcgatgcccattgcgtccagcatgtcataatgataggccatatccttgaccgcatttgcggtaatctcccgtttcgggcttgtaaaaagcgtgaattggttcggatgaaagctcgttctgaggtcatattttctgaccagcccgccgatctcacgaaactcctggcgaaacggcgtgacaaaatcccacagtacatccgggtgcgtggcgagcggcacaattgagcttgagaacctgtacaaagggatgccgtggccgaccacatagtggagggtgcgcagcgtattggtaagatttgctttcgtcacagaaagcagagcgtctttccgctcactgcgggaaagcttggtatagcgcgcatatgttaaggttttggcgggggacgcgtcccaaaggcacatggcgtttgcgacgaatccgaatctgaacagcatatggtttctcctttataaaaagtaagatatggcctttcccagccattctgcaggaagctgtctgacggagcgctgtttcactttttctaatgtgagaagctcggatttttcgatgtcctgctttatggttgaaagcacttcctttgtaaaggcctcatcatgaatgatgacatttacctcttcattccagaacaggctccgtttatcaaaattcggcgtgccgataatgctgatgcggtcatctataatgaaggctttaacatgataaaagccttgataataccgatagatgaggcagccggccttcaggagctcgggataataggtaaaagctgtttcccgaacgagcgggtgatctgatttcatcggaacgatcaagatgactttgacgccttttcggcaggctgaaataagcgcttcctgaagctttttgctcggtacataataaggcgtgccgatgatgatttttttctccgccttacggatgcagttttcataatgcgattcaagcgaaaaaccgtcagatgcatatgtcctatgagagatattcccttcggataatgccggataaaccccgggtgattcgggtgtttttccggtgtttcgtttcaggtcgcttacaaaaagagtctgaagatctgccgtgccttcgccggtcatccgcaggtgataatcctcccagtttccgaacttcgctttttttccgaggtactcttcagcgatattaaagccgcccacatagccgattttgccgtcaatgacggtcactttccggtgattccgtttttgcagcctgaaaaaaagaaagggaaatgccggtttatttagaaaatgaacgtgaacgccggcttttttcatcgtttgaatggaaggctttttcacttggcggctgcccgcccaatcgagcagcagatatacggagacgccggcccgggccttttctttcaataaatcaaacatctcatggctgacttggtcgttcttcataataaaaaacatcatatgaatagaagagacggcttggcggatatcagccgtcatctgctgcacaagctcgctgccgcagtgaatgagtgtgatatcactttttttggggtcaaaaacgggctcatacgcctgttttttgtacgccgcccggccaagcagcatatcaagcagcataagtgcgatcaatatgataaaaatgacaagcaacacaaaaatgaccttcataccgacgctcctttccgaagtatccgtagtgtgccctgagaatgtgaatttaattattgactgaacactcattcattatttatgataaagtaaagatatgacaatgaagaggggaatcagaacaaagggggagacaagatgaacgcatttctcatggtaaacgcgctgctgttttcagctgtaaccgcttacgccgtttatttattcgtttacctgatcagaacgaggatcgcttatattaagctcggccaaagggaagaatttgataaacgcctgaaagaacgtcttcagaagatatgggtgaatgtgttcggacagaaaaaattgctgaaagataaaaagagcggaatcatccacgttctgtttttttacggttttatactcgttcagttcggcgcaattgattttattctgaaagggctgcttcctgaccggcatctgccgttcggcccgctttatccggcatttaccttttttcaggaaatcgtcacgtttctgattttaatcgccgtagtctgggcgttttaccggcgctacattgaaaagctcgtcagattgaaacgcgggtttaaagcggggcttgtcctgctgtttatcggcggactgatggtgacggtgctgctcgggaacgccatgaaccttttatggcacgatcattctctgtcttggacggaaccgatcgcttcctccattgcgtttgtgctcggcggtctttcagcgccggcggccgccgccgtgttttatgtttcatggtggcttcatctgttgtttttgctcagctttttagtgtacgtgccgcaatcaaagcatgcgcacttaattgcgggtccggcgaatgtgttcctcagcaggctggattcaaaaggaaagctggaaaaaatcgattttaccgatgagacgaaagaaagctacggcgtcggaaagattgaagacttccgccgctctcagcttgtcgacctttacgcctgcgtcgaatgcggccgctgtacaaatatgtgtccggcctccggtacgggcaagatgctctcgccgatggacctcattttaaagctcagagaccatttgacggaaaaaggcgctgccgtgacatcaaaatctccgtgggtgcccgcgcccgtttttcagcacacgaaggcgaatcagctcgccgcggcttcctcagggggaggatcgcgtgaagcggcggcagccattgattacaacccgagcttaatcggcgaggtcatcacggaagaggagatttgggcgtgcaccacttgccgcaactgtgaagatcaatgtccggtcatgaatgaacacgttgataaaattatcgatctgcgccgctatcttgtgcttacggaagggaagatggacagcgacgcgcagcgggccatgacaagcattgaaagacagggaaacccgtggggcttaaaccggaaagagcgggagaactggcgggagcaggctgatacagagattccgacagtgaaagaaatgaaaaaacaagacaaagagttcgactatttgttttgggtcggctcaatgggttcctacgacaacaggagccaaaagattgccgtttcatttgcaaagctgctcaatgaagcgggcgtatcctttgcgattctcggcaataaggaaaaaaactcaggcgatacgccgcgccgtttgggcaacgagtttctgttccaagagctggcggaacacaacatcggcgaatttgaaaaacacggaatcaaaaaaatcgtcacaattgatccgcacgcctataatatgttcaaaaatgaataccctgatttcggattccgggccgaagtctatcatcatactgaattattagccgagcttgtgtcacaggggaaactaaaaccgcttcacccggtcaatgaaacgattaccttccatgactcgtgctatttaggaagatacaacgaagtgtatgagccgccgagagcgatcttaaaagccattccgggcgttcaattgaaggaaatggagcgcagccgcgaaaacgggatgtgctgcggcgccgggggagggctcatgtggatggaagaagaaacgggagcgaggatcaacacggcccggactgagcaggcgctttctgtcagtccgacggtcatcagctccggatgtccttactgtctgaccatgctcggtgacgggacgaaagcgaaagaagccgaagacgcgatcggcacttatgatgtcagtgaattgctcgccatgtctgtattcggcgccgaaaaacaagagtctttatagaaagaagcgggccgccggcgcatatgccggcggctttgttttcgcacatcagccgatttatgaaggggcggctctaaaatttcttaaattacgctgtttagggtagcatattctgttttaatttgtttataatgagaggtatggtttatgaacaaaacaatacaaattcgttcttattataggatagaaacagatacatataagtaatagaaagggagtgtccgaccttgagtatcaaacaatattctcaggaacagctgaagcagatggctttagttgaaatcgctcacgaaattttctcagaacataaaaaaccggttccgttccaggagctgctgaatgaaatgatctccttactcggtgttacgaaagaggaactgggcgaccgtatcgcccaattttatacagacctcaacattgacggccgctttattgctctgtcagatcagacatgggggctccgcagctggtatccgtacgatcagctggacgaagaaacacagccgactgtaaaagcgaaaaagaaaaaagcgaaaaaagccgttgaggaagatctcgaccttgatgaattcgaggaagttgatgaagatgacatcgatctcgatgaaatggaagaagatattgaccttgacgcagacagctttgacgacgaagatatcgatgaagaagatgacgacgagcttgagattgaagatgagatgattgaagaagatgaggaagattatgatgatgaggaagaggatcgcaaagactgattttatatcagcaaaacgatcttgactttcattgtcgaactatgtagtatgtattttgggctcttcaaaaagaagagaattcataagagtgctacgctccctttcaagaaattgaaagggagctttcttattttcatctcccaaattcttttacacatcatttgtttttagtgaaatgattttctataaaacggcacattttaaggaatgtagcgcagaccgaagagaggagcaaacgaaatgacgaaatatatttttgtaaccgggggagttgtatcatcactcggaaaaggaattgtggcagcatcacttggccgccttttgaaaaacagaggcatgagcgtcaccatccaaaaatttgacccttatatcaacgttgacccgggaacgatgagcccgtaccagcacggtgaggtattcgttaccgatgacggcgctgagactgaccttgacttagggcattatgagcggttcattgacattaatctgaacagattcagcaacgtgacgacaggtaaaatctattctgccgtattgaaaaaagagcgccgcggggactacctcggcggaacggttcaggtcattccgcacatcacaaatgaactgaaagaccgtgtgtaccgtgcaggcaaagaaacaaacgcagatgtagtcattactgagatcggcggaacagtgggagacatcgaatctcttccgttccttgaagccatccgtcaaatgaaaagcgacatcggccatgaaaacgtgatgtacattcactgtacgcttgttccgtacatcaaagcggcgggcgagctgaaaacaaaaccgacgcagcacagcgtaaaagagctgagaagcctcggtattcagcctaatatcatcgttgtgcgcacggaaatgccgatttctcaagatatgaaagataaaattgcgctcttctgcgatattgacacgaaagcggtcatcgagtgtgaagatgcggacaacctttactccatcccgcttaaccttcaggagcagggactcgataagcttgtctgcgatcatatgaaattagaatgcaaagacccggatatgacggaatggaaagaccttgtcacgaaagtgaaaaacttgtctaaaaccattacaatcagccttgtcggtaaatacgtcgagcttcaggacgcttacatttcagtcgttgaatcactgcgccacgcgggctatgcgtttgacgctgatgtgaagatcaaatggattaacgccgaagaagtgacagaaagcaatattcaagagctgactggcggcacagacggaatcatcgtgcccggcggtttcggggaccgcggcgtagaagggaaaatcatcgccgccaagtatgcgcgtgagaataaaattccgttcttcggcatctgcctcgggatgcagattgcatccattgaatatgcgcgaaacgtattaggtctggaaggggctcactctgcggagatcgatccgtccactccttatccgatcatcgaccttctgccagaacaaaaagatgtcgaggatcttggaggaacgcttcgtctcggactgtacccttgtaagcttcaggaagacacgaaagccttcgaagcgtattcggatgaagtggtatacgaacgccaccgccaccgttatgaattcaacaacgaatacagacagcaaatggaagagaacggttttgtgttctcaggaacaagccctgacggccgtcttgtggaaatcatcgagctgaaagaccatccttggtatgtcgcttgccagttccaccctgagttcaaatcaagaccgacaagacctcagcctttattcaaagactttatcggcgcttccgtacaagctgcagaacagaagtaataaaaaaagacttgcctcctttaaaagcggcaagtcttttttctgcatcaggcatattcctgcatcatttcctttaacgtaaaggacagcgcgtgatagacatacaggcctgtcattaatgaaggaaagccgtatcttgtcccgtcttcatcgggcagaagcggcatttttaatttgctgtcaatatgaacatcacaaaattcctcaatcccggtttgatctttgatgacaggagatacgcaaacgaggccgacccctttttcataaagcttttgagccagcgcctgttcttcagccgtgcccggacctgaacaaaacatcagcaccctgtcgctttctgtaatcgaatcagctgtatccggaaacgctttgacagaaggcatcggttctgagccgagttccgcctcgcacaaaatgccctgcatctcatttgcgccgtataaataaatggtatgaccgctgacggctgcctgcgccagcaggcgcgcgccgtcttctattgcatcggactccttatcctgaatgcgggaaaaaatgcctgcaagctgcgtcgtaaatatctttaacatgagtgaaacctcctttacacatacaagaacagtatacaacaaaagagaaaatgctcagaaaatgtcggaaagtagactattataattaaaggaaatgtgaaaatcaaacagaatacataaacaactgcttccttttgacgaaaatgataatattggggtgtaaaatgatgaatgaaaagattttaatcgtagatgaccaatacggtatacgcatattgctcaatgaagtgttccataaagaagggtaccagacgtttcaggccgccaacggcatacaggcgctggacatcgtaacgaaagaacggcccgatctcgtgcttttagatatgaaaatccccggcatggacggaatcgaaattctcaagcgcatgaagatgatcgacgaatccatccgcgtcattatcatgaccgcttacggagaactcgatatgattaaggaatcaaaagagctcggagcgctgactcattttgcgaaaccttttgacattgatgagatcagagacgcggtgaaaaaatatttacctctaaaatcgaattaataaaattagaaacaattatgtcattgtgttgccgatttgtcgaaaagttggtatcctagagatggagaaaaagcgatctgttgttttacatatgacaggtttttatggtcatgctataggtggaaagcttttttcgagaagaagcaaatcaggctacataaggaggactttcgacatgcctttagtttcaatgacggaaatgttgaatacagctaaagaaaaaggatatgctgttggacaatttaacttaaataaccttgagttcactcaagctattttacaagcagcagaagaggaaaaatccccggttattcttggtgtttcagaaggcgcgggacgctacatgggcggcttcaaaacagtggttgccatggttaaagctcttatggaagaatacaaagtgacagttcctgtcgcgattcacttagaccacggttcaagctttgaatcttgtgcgaaagcgattcatgcaggtttcacttctgtaatgatcgacgcatctcaccatccgtttgaggaaaacgtagcaactacagctaaagtggttgagcttgctcatttccacggcgtttcagttgaagctgagcttggaactgtaggcggacaggaagatgacgtgatcgctgaaggcgtaatctatgctgaccctaaagagtgtcaagaacttgtagagcgcactggcatcgactgccttgcacctgcactgggttctgttcacggcccttacaaaggcgaaccgaacctcggtttcaaagaaatggaagatatcggcaaatcaaccggccttccgttagtacttcacggcggtacaggaattccgactgccgacattaaaaaatcaatctcacttggtacggctaaaatcaacgtaaacactgaaaaccaaatttcttctgcaaaagctgtccgcgaaacattggcagctaagccgaacgaatacgatcctcgtaaatatcttggacctgctcgtgaagcgatcaaagaaacggttatcggcaaaatgcgtgagttcggttcttcaaaccaagcttaatccaatgtaacatccataaaccgcctgacagcattgacaggcggttttatgtcttacctttagaaagcgcaatcatgttttacagttctgaaaatttattactggggaggctttccttatgttatttttcattgatacagcaaacattgacgagattaaagaagcttatgaacttggcgttcttgccggagttacgacaaaccctagtttagtggcgaaagaagctgacgtgtctttccatgacagacttcgtgagattacggaagtcgtgagcggatcagtaagcgcggaagtcatttccctgaatgctgaagaaatgattgaagaaggtaaagaacttgcgaaaatcgcgccgaatattacggtgaaaatcccgatgacgtctgaagggttaaaagccgtaaaagcgctgagcgacctgaacattaaaacaaacgtaacgctcattttcagcgccaaccaggcgcttttggcggcaagagccggggcgacttatgtatctccgttcttaggccgtctggatgacatcggccataacggtcttgaactgatttcagaaataagacagatttttgacattcatgacattgatactcaaatcatcgcagcttccatccgtcatgcgcagcacgtgactgaagccgctttacgcggtgcgcatatcggtacgatgccgctgaaagtcattcaccagctgacgaaacatccgttaacggataaaggcatcgagcaattcttggctgactggaataaataagggggaaaagggcggcaaaccggttgcatccgtttgccgcacccttatgttttcctgtttggcagcgggccttcagtatcaaagtgaagagtgtgtttccccggaatatgaacccggcgggcctctgtgcatcctgtgttaaaaatgccccgcaaagcttcgctattttcttcctgttattttataatgtccttgtattctttctcttcgaattggctacattttggacaagagctttatttgcagagacagaataaaatgccattttatttacgctccgcagctatcttcttatggaaggagactatcatggaaaagttgaatattgccggcggcgatccgttaaacggaaccgtacatatcagcggtgcgaaaaacagcgccgtcgcattgatacccgcaaccattctggcaaattccgaagtaacgatcgaagggcttccggagatctcagatattgaaacgctgcgtgacctgctgaaagaaatcggcggaaacgtccattttgaaaaaggagaaatggtcgttgacccttccccgatgatcagcatgccgcttcccaacggcaaagtgaaaaaactccgcgcttcctattacttaatgggcgcgatgctcggccgcttcaaacaggcggtcatcggactgccgggcggatgccatctcggtccgcggccgattgaccagcatatcaaagggtttgaggcgcttggagcggaagtcaccaatgaacaaggcgcgatttatctgcgcgccgaaaggctgagaggcgcacggatttatttagatgtcgtcagcgtcggagcgacgattaatatcatgcttgccgctgtactggctgaaggtaaaaccgtgatagaaaacgccgccaaggaacctgagattattgatgttgccacattgctcaccagcatgggcgcaaagatcaaaggtgcgggaaccaatgtaatcagaatcgacggcgtaaaagagctgcacggatgcaggcatacgatcattccggacagaattgaggcgggcacctttatgatcgccggcgccgcgatggggaaagaagtcattattgataatgtcataccgactcacctggagtctttaacggcgaagctcagggaaatgggtttttacattgagacgagtgacgatcagcttcttatgctcggcgggcagaagcagataaaaccggtcgacgtgaaaacgcttgtttacccgggattcccgactgatcttcagcagccgatgacatctctgttaacgagagccagcggcacgagcgtcgtaaccgacaccatctactcggcccgatttaaacatattgatgagctgagacggatgggggccaatatgaaagtggaaggcaggtcggccattatcaccggtccggccgagcttcagggcgcaaaagtaaaggcgagcgatctgcgtgcaggcgcttgtctggtcgtcgccgggctcatggctgacggcgtaaccgaaattaccggtcttgagcatttagaccgcggctacagcaatcttgagaaaaaactcgaaggtctgggcgccacaatctggcggcaaaggctgacggacgaagagatagaacagctccaaaattcatagaaatgcggacttttgagaggagatcgtgttgaaatggaaagaagcttatcgatggaattggttcgagtcactgaagcggcggctttagcatctgccagatggatgggccgcgggaaaaaagatgaagctgatgatgcggcgacaagcgcaatgcgtgacgtgtttgacacggtgccgatgaaaggcacggtcgtgatcggggaaggcgagatggatgaagcgccgatgctttacatcggcgaaaagcttggaaacggatacggcccgcgcgtcgatgtcgccgtcgatcctcttgaaggcacaaacatcgtagcgagcggcggctggaatgcgctgacggtgatcgcggtcgccgaccatggaacattgctgaacgccccggatatgtatatggaaaaaatcgcggtcggtcccgaagcggtaggctgcatcgatatcgaagcgcctgtcattgataacttaaaagccgttgcgaaagcgaaaaacaaagacattgaagatgtcgtggcaaccattttaaatcgtgacagacacgaaaaaatcatctctgaattgcgtgaggcgggcgccagaatcaaactgatcaacgacggtgatgtcgcgggcgccatcaatacggcctttgaccatacgggagtagacattctcttcggttcaggcggggctcctgaaggcgtgctgtctgccgttgcgttaaaagcgctcggcggcgaaatcatcggcaggcttctgccgcaaagtgcggaagagcaggcccgctgtgagcgaatgggccttgatgtatccaaagtgctccggatggaggaccttgtgagaggggatgacgccatttttgccgcaacgggtgtcacggacggagagctgctgaaaggcgttcagttcaaaggctccgtcggcacgactgaaagcctggtcatccgggcgaaatcaggaacggtccgattcgttgacggaagacacagcctgaagaaaaaaccaaatcttgtgatccggccataaatagagaaaagcgggacggaaagtcccgcttttcttttgcaaaaaagagtcaaccctatcatttatatgtcaaagcattatttaagttgaataattttttgaaatgaggtaaaaataaagagtgctgcgatttttctgtgtcattccttcttttgagtactgggaaattttcaaattctaccgcatacagacgatataaatattgatcttctcaagtttttgtcctcgcttccttcaaaactcattaagacattccttttttaaaaaagcgccgatcatgggtggaagtgttaccgatagaagttcctgaacgttttataaaagaatgtgctttggcggaatcatgcgaagcagccgatttgaatgaaaacagcaatacattgactatgaaaagcgtggtgtttttatgaaagacgtatctatttcctctttggaaaatatgaaattaaaagaactatatgaactggccagacattataaaatctcctactacagcaaactgactaaaaaagaattaatctttgccatcctgaaagccaacgccgagcaggaggatcttctgtttatggaaggcgtgctcgaaatcatccaatcggaaggattcggcttcctcagaccgattaattactcgccaagctcagaagacatctacatttctgcttcccagatccgccgctttgatttaagaaacggtgacaaagtatccggcaaggtgcgtccgccgaaagaaaacgaacgctattacggacttttgcacgttgaagcggtaaatggagacgatccggaatctgcgaaagagcgcgttcattttcctgcgctgactccgctttatccggaccgccaaatggtgcttgagacgaaaccgaactatctctcaacaagaattctcgatatgatggctcccgtcggtttcggccagcgcggtctgatcgtggcgccgccgaaagccggtaaaaccatgctgttaaaagaaatcgctaacagcattacgacaaatcagcctgacgctgaattgatcgtgctcttaattgatgaaagaccggaagaagtaacggatattgaacgttccgtagcgggcgatgtcgtcagctcgacgttcgatgaagtgccggaaaatcacattaaggtagcggagcttgtgcttgaacgggcgatgcgtctcgttgaacacaaaaaagacgttatcattctgatggacagcattacccgcctggcacgggcctacaacctcgttatcccgccaagcggacgtacgctttccggcgggattgacccggctgcgttccatcgtccgaagcgctttttcggtgccgcgagaaacattgaagagggcggcagcctgaccattttggcgacggcgctcgtagacacgggctcccggatggatgacgtcatctatgaagagtttaaaggaacgggcaacatggagcttcaccttgaccgttctcttgcggaaagacggattttcccggcgatcgatatccgccgctccggcacgcggaaggaagagctgctcgtgccgaaagagcatcttgaccgtctatgggcgatccgcaaatcgatgtctgattctccggacttcgcagagaagtttatgagaaaaatgaaaaaaacaaaaacgaatcaggaattcttcgatctgatcaaccaagaatggaagcaggcaaacctttcatcatcagcccgccgctgataaaaaatgtatttgcaaatgcagtaaatgactgatataattctctcatatgcgttccggattcgctccggaataataactctgtttccacacgggattcagggcggaaggagatggatacaatgaaagcaggaattcatcctaatttcaaaaaagcaacagttaaatgcgcttgcggaaatgaatttgaaacaggctcagtaaaagaagaggtacgcgttgagatttgctctgaatgccacccattctacactggacgtcaaaaattcgcttctgctgatggtcgtgttgatcgctttaacaaaaaatacggtcttaagtaataatagattttacaggcaggcaagaattgcttcttgcctgttttttatgtccataaacaggaaaaaaaggggagcggatagcctatgtacataatgaagcaaagcggatggcttgagctgatatgcggcagcatgttctctgggaaatcagaagagctgatccgcagagtgaaaagagcgacatatgcgaagcaggaggtcaaggtgttcaaacctgccattgataatcgctacagtgaggaggctgtcgtttctcacaacggcacatccatgacaagccacgtcatctcgtcttcggctgaaatatgggatcatatcagtgaaagcacggacgtcatcgcggtagatgaagtgcagtttttcggcgaatcaatcatcggcgatttatccttgcttgcggataaaggctatcgtgtcatcgcggccggacttgatatggatttccggggagagccgttcggtgtggtgccgaatctgatggcggttgccgaatcagtgacgaagctgcaggcggtctgctccgtttgcgggtcgccggcaagccgtacgcagcgtttgattgacgggaagcccgcttcctatgatgatccggtcattttagtcggcgcgtcggagtcatacgaagcgagatgcagacatcaccacgaagtgctgaaaaaacagactgataaataacccttttcatgaaaacatcggtaaaaaatccggtgtttttttgacggtttttcaaaaattgtagttaattaacttaaaaaagagtatgaaaaaattaagtaattttcatctcttgaattttcatttttacaggcataaaatgactaagtaatgtaaatagttatgagacattgttcgaataattgtcaaaaaaagatatagcagatcgcgatcacactagccaaaatgggtaattacttaactttgttaactatttgaagaaagaaggagattttcttgaataatattaaagtaacgaaggaaggcaacttagaaactactttaagaggaaaagaagttctatctatccctactttaaataaaggtgttgcgttttcagcagaagaaagaaaaagccttggattagacgggctgcttcctccgaccattctgtctcttgatgagcaggcaaaacgcgcatacgagcagtttcaagctcagccggaccgccttcgccaaaacgtgtatttgaatgatttgcaaaaccgtaacgaagttcttttctttaaattgcttcaaaaccatcttcgtgaaatgctgccggttgtttacacaccgactgtcggtgaagcgattcaagaatacagccatgagtacagaagacctcaagggatttacctttctatcgacaatgtagaaggaatcgaagaggcatttgaaaaccttcatgccactgccggagatattgatctgatcgttgcgacagactcagaaagcatcctcggaatcggtgactggggtgtaggcggtatcaacatcgccatcggtaaattagccgtatacacagctgctgccggtattgacccaagccgtgttattcctgtcgttcttgacgtcggtacgaacaacgaaaaacttctgaacgatcctttatacatcggtaaccgccatgaacgtatccaaggcgaacgttatgaagctttcattgacgcttatgtaaaagctgcgcttaaatatttccctaaagctcttcttcactgggaagaccttggaaacaaaaacgcgcgcaatatcatgaagaaatacaatcatgaaattcttacattcaacgatgacattcaaggaacaggcgcgattacgcttgcaggtgtgcttgcggctatgaagaaaacaggcgcgtctattaaagaccagcgtgtggttgtcttcggtgcgggatctgccggaatcggaatcgctgaccaaatccgcgacactatggtgcttgccggtctttctgaagaagaagccaacaaagcgttctacacaatggactacagaggcttgttaattgaaggtatggaaaacattcttgatttccaagagccgtacctgcgcacagctgaagaaattaaagattggaaacgcgatgaaaacggacaaattcctttcattgaagtgatccgtcaagcgaaaccgacaatcttaatcggtacatcaggccaaagcggcgcgttcagtgaagaaatcgtcaaagaaatggcaaaacacgttgagcgtccggtcatcatgccgatgtctaacccgacaccgcttgctgaagccgttcctagcgatctattcaaatggactgacggcaaagtgcttgtggcgacaggaagcccgtttgacaatgtagagtacaatggcgtttctcatgaaatcggacaatctaacaacgcattcgcgttccctggacttggtctcggttcaatcgttgtagaagcgaaagtgattactcctgcaatgtttgcggcaactgctgacgcaatcgcagaaagcgttgattttgaaacaccgggtgcaggccttctgccgagcatgagcgacttacaagaagtttcaattaaagttgcgatcgccgtagcggaaactgccattaaagaaggcgtggcaaaccgcattcctgagaatgtagaacaagccgttcttgatgcaatgtggaaaccgcaatataaacaagttatcgctaaataatttttacgattaattttacagtccgagggaaagcttttatgtaaaggctaaagtatacggacattaaggatttggaggagaatattttgagcttcttagatattttaatcctcctggcgccgatctttttcgtgatcgtgctgggatggttcgcaggtcgcttcggaagttatgacgcgaagtcagcaaaaggggtaagcaccttagttacgaagtacgcgcttccggcgcattttatcgcaagtattttaaccacttcaagaagtgcgtttttatcacaggttcctttaatgatcgctttgatcattgggattgtcggattctttatcgtcattttgttggtttgcaaatttatcttcaagtatgatttaacgaattcatctgtattttctttaaactctgcacagccgacatttgcatttatgggtattccggtactcggaagcttattcggagcaaacgaagtagcgattcctatcgccgttacgggtatcgtggttaacgccatccttgacccgcttgcgatcattatcgctacagtcggtgagtcatctaagaaacaagacagcgaaaacgagaacttctggaaaatgactggtaagtctattcttcacggtctttccgaaccgcttgcggctgcaccgcttatcagtatcatcctggtactctgcggtgtaacactccctggcttgggtgaaaaaatgcttgatcagctcggaagcacaacatcaggtgttgcactctttgccgtcggtgtaactgtcggtatccgcaacatcaagctcagtctgccggctttcggtatcgctttgttaaaagttgccgttcagcctgcgctgatgtacttgatcgctcttgcagtcggacttccggctgaccagatcactaaagcggtattgctcgtcgcattccctggatctgcggtagcggcgatgattgccacacgtttcgaaaaacaagaggaagaaactgcgtccgcgttcgtgatcagtgcgattttatctcttatctcactgccgatcatcattgcgctgactgcataatgaaaagctccctgtttcagggagcttttttgattagaattgaaatttaaaaggcgaaaatctcgttttttttctgggtttcttatgttctgaagaagcggctgtttctgagaggggagctgtctgggcaagttcctggatgcgggaggccaatgtctgcaattcggtattgaggtcgtcaatttcccgtctgtgctgaagaagctgataagacaccccttcatccgccttttgtttcagctggcgttcaagctcctctatccttgaaagcagatggttctcatcctgtttctctttcgtgagaatgtccagtttgcgctccagctctgccaacctttgttcagcgccgccattgattttcggacgctgcaaaatgaagcccgtccgttttttcggctgccggggcacttgaacgtccagaagggcagtgccttcagaaatttgccgtttgaccgatttcagcacatcaagatcctcaggtgtaaaggaataatgtccgagctcattccgttcagccggaagattcagctgcttgacccacctttgcaccgtttttgcggagacgccgagctctttcgcggccatgtttgtattcatgatcacatacctcctttttgctaggtattcgaccatgaggcggcgttcccttcatgttagacaaaacaagaaggaattcgccaaagaaagcggcatttcttcaaaaaacgttacgcttcatacaattcaagcggaagcttgtcgggatcgaagaaaaaggtaaaccgtttccccgtcagcggatcggttctgatcggttctgtgccgacgccctttttctttaactccctgacggctgcttcaagatcgtttacggtgaaggcgagatgccggagacccgcggcttccggtctggtcggccgttcgggcggatcgggaaaggaaaacaattcaatcgcatacgcgccgtccagcgccagatcgagtttataagattcccgttcctttcggtatgtttcttttataatgccgaaaccgagtatctcggtgtaaaaagctttcgacttttcataatcagagcatatgattgctatatggtggatggatttcagcatatccgcccctccttttttgcttcagtataacagaggcgaattgcttttgactggtgataagccctatactataatgagaatgttacgcacaggaaaacagaggtgaagaccgtgttagaccgtttacagtcaattgaacaacgatacgaaaaattaaatgagcttttaagtgatccggaagtggtcaacgatccgaaaaagcttagagaatattcgaaagagcaatctgatatacaagaaaccgttgaagtctatagacaatacagagacgcatcagaacagcttgccgatgcgaaagcgatgcttgaggaaaagcttgatgccgatatgagagaaatggtgaaggaagaaatctccgaactgcagggagagacggaaaccttatcagagcgtttgaaagtgctcctcatcccgaaagacccgaacgatgacaaaaacgtaatcatggagatccgcggagcagcgggaggagaagaagccgcgctgtttgcgggaaatctctacagaatgtactcccgttacgctgaaatccaaggctggaagactgaagtcatggaagcaaacgtgaccggaacgggcggttacaaagaaatcatctttatgattacgggaaaaggcgcatactccaagctgaagtatgaaaatggcgcgcaccgcgtacagcgtgtgccggaaacggaatcaggcggccgtattcatacatccacggcgacggtggcgtgtcttcctgaagcggaagaagtagaagtggacatccacgaaaaagacatccgcgtcgatacattcgcatcaagcggaccgggcggacaaagcgtaaatacgacgatgtcggccgtacgcctgacgcatttaccgaccggtgtcgtcgtatcctgtcaggatgaaaaatctcagattaaaaataaagaaaaagcgatgaaggtgctccgcgccagaatctatgacaaattccagcaggaagctcaggctgaatatgatcagacccgtaaatcagccgtcggatcaggcgaccgttccgagcgtatccgcacatacaatttcccgcaaaaccgtgtgacggatcaccgtatcggcctgacgattcaaaagctggatcaaatcctggaaggcaagcttgatgaagtggttgaagcgttaatcgtagaagaccagtcaagcaagctccagcaggcggaaaattaagatgaagaccgtttttgaagccctaagctgggcttcttcttatttaaccgaagcgggaagagaaaaaaacgcggccgagctgctgctgttaaatgataccggaatggatcggagcaagcttctcgcaagtctgcaggagcccgtcggcgaggacgagctttaccgattcagacggcatgtggaaatgcataaagaaggcgttccgattcaatatattatcgggaaagaacagttttacggcagagaattctttgtgaatgacgatgttctcattccgcgtccggaaacggaagaagtcgtctttcatctgctggacagacagaagcgggtgttttctgagggagaacgcctgaacgtcattgatatcggtacggggagcggagccattgcggtgacgctcgcgcttgaatgcggacatttttcagtatcggcttcggacatttcaaaagaagcgcttcaggtggcggaaagaaatgcgcaaaacctcggagcggacgtccgctttttgcagggagatctgttaactccttttatttcatcaggaataaaagcggatattattgtttccaatccgccgtatatttctgaagaagaaatggcggatttgtcggatatcgtccgtttccatgagccgcttcatgcacttacggacggcggtgacggtttgaaattctacaagcggtttatggaggagctgcctcttgtcatgaaagataaagcgcttgtcgtctttgaaatcggatataatcagggaaaagccgtgaaagacctgttccgtcattcctttccgaatgcggaagtggaagtcgtacaggacatcaacggaaaagacagaaccgtatccgcggtcatcacatcatgaaaaaagcccgccggtgacgcacacggcgggcttttgttacaatggaaagaaaatgaaaggggcatccgccttgaaaaaagcgttcgccttcggatgtatactcgccgccgcagcttatgcggctggatttgtcctgccgtttggctttgacatcattctcggcgccgttacggctgttcttatcgtcgcagcggtcatcgtttccgggctggccgtaagcggagcggagcagcgggccaattatcattctgaaacagaagaaggacggcgcgcccgtttaaagatggccgccgttttcttttgcgccgctctcccttcagccggctgtctgctgattacgcttctgtagccggattttgtctttgcagcaatacggaatcccatacccaatagacgacggctgttaaaaccgcaaagatataaaaggctgaattagaaaacagagattggcctgacggctgcaaaagaccgaagatgatcccgtttgcaatgaacgacacccccaaataataaagaaaatacagcggatgaaatctcttcggctttttattcagaaagtattgaagcggcagcgcaaaaatcaaataaggaaacaaaaaataaaacgccatcgaaatgaaagccgcgataatgaattgatgaacatacaaaatagaataaatgacagacatacatgccgccgacagcagcacggtgtaattatatttcatctgaaaacctcctatcaaaataatatcgtaccatattttgaatctgtcaatgcagattatcagcttgctagatttttttcttcccgccggtttaaaccttttccgtcatgtccataatgggactagataaaaaaagcacggagaggaacggtggggaccgatgaaacagacaatgatgatctgcatatatatttttcttttattatcaggagcgcttgcgggtttgacaaaagaagaaacggcgcgggcatcagccgatgagcccgtcgtcataccggatgaagcgatccggctcaggattttggccaacagtgataacgatgaggatcaaaagctcaagcgccagatcagagatgctgtaaacaagcaaatcacggactgggtgaaagatatcacttccattgaagaagcgcggcggctcattcgttcgaagcttcctgaaattaaagaaatcgccaaacaaacgatgaaagaaaagggtgcgcatcaatccgtttcagttcaattcaataaaatctcgtttccgacaaagctgtacggcaatatggtctatccggccggaaaatatgaagccattttaattacactcggcaatggcgagggcgccaactggtggtgcgtcttgtttccgccgctgtgcttccttgatttctcaaacggcgaagcggtgaaagatcaggaagacggcggacagaagcaggaagaaacgcagaaacagacagaaaaagtgctggatgacgtaaaagcaaaggccgataaagcgaagaaagaaaataaagatgacgatgataccgaagtgaagtttttcctcgtcgattggatttcagatctattttcctgaagcaaaaggcataaatccggattcgattcatagattggaagaaagagttgatcgaaacggagggaaatatatgttttatcagctgagagtggcaagagatcaagatacggaggcgctggaggcctttttgaaaaagtctgatacggcacatgcggaaatcgatcagcagatcagccggtttatcgtgctggaagacagcgaaaaaaagattgccgcctgtctcgggatcgaaaaattcagcggcggaaaagggcttctccgttcactcgtcatgtcggacaggctgaatcaaagccatatcgttacactgtttcaaagtatggatgtgctgtgcaaaaaacatgaaattcaagatgtctacttagtcgccaatcagccctcatctgctgagtttctgaatgtgatgggatttgaagcgtgcgccgatgcgcctgaggaactgtatacgtccgaacatttccgcaactcgttatgcacagaaggttcgtttttaatggtgaaaacctctgcctgatctaacttatacacaaggttatccacttattaaaaagtgttgtccacagtttgtggataacgcttgttttattaaaggacatcttttatactttcaaaaggaatacacgagagaaaataaagttttaccgctttaaaataaggagtttggttatacatgaaaacaagaagatggtttgtggattgttccgcagaattatccacaaccgatccccaaattacacaagccgcggaattgctccggcagaatgaggttgtggcttttccgacagaaaccgtttacggactgggcgctaacgctgaaaatacggaagccgtaacgaaaatatatgaggcgaaaggaaggccgagcgataacccgctgattgtgcatatatcccatatcagccagcttgatcgttttatcagccatattcctgagacggcgaaaaagcttatggagctattctggccgggggcgctgacccttgtcctgccgtgtaagcccggtgtgctgtcaccccgtgtcaccgcgggactggagacggtagcggtcagaatgcctgatcatccggcagcattagccctcatcagctcggccggactgccgatcgccgcgccgagcgccaatttatcaggaaaaccgagcccgacgaaggccgagcatgtagctcatgatttaaacggccgtattgccggtattgtggacggcggcgcgacgggaatcggagtggaatcaaccgttctgtcctgtacggggaaacagcccgtgctgcttcgtccgggcggcgtgacaaaagagcagattgaatccgccgccggtccggttcttgtggataaaggactgaccgaagaagatgaggttcctatttctcccggtatgaaatatacacattacgcgccttctgcgccgatggctattgccgacggcggcgcccggagaattcaagaactggcagacgcatataaaagccggggaaaacgaatcggcattttgacaacagaagagaacgccgatagttaccaggctgattatatcaaggtctgcggcagacgcgccgaccttgaaacagtggcgtccgccttatacgatgcgctccgcagctttgatgaagcggaagtggatatgattatttctgagtcctttccggataccggagtggggctcgccgttatgaacaggctgatgaaagccgcaggcggcaccgttatccattaacttgttctaccccttatcggacatgcataagctaaacaagcgggcacgtccaagggggtttttattcatgtcgaatctattcatcggggaacttgtctccttaagcatcatggcatttgctttggggacggatgccttttccgtcgggctcggaatgggaatgattcagctgaagaaaaaacagatttttcatataggggttgtcatcgggctgtttcatgtcatgatgccgcttgtaggaatggcggccgggcatctgctgtccggttttctggggatgctcgccgtttacatcggcggatctcttcttttcattttaggggtgcagatgatgatcgccgcgtttaaacaatcggacgggccgctcatatctccggcaggctcgggactgttgctgtttgcggtcggtgtcagtctggacagcttttctgtcgggctcagtctcgggatgaacggctccaatccgtttctggccgttacgctgttcggggtcttcagcaccgttttaacatgggcgggccttttggcgggaagaaaggtgcagtcatggctcggctcctacagcgaagcgcttggcggagccattttgatcggattcgggctgaaactgcttttaccgatataagatacgtaaaaaaagaaacgaagatgccgtttcttttttcttcatttataataggtagtaagaggtgacggacatgaaaataatctttgtttgtacaggcaatacgtgccgcagtcccatggctgaggctctttttaaatccatagcagaaacgaaagggctggatgtcagcgtaagctcggccggcgtattcgcgtctccgcacggaaaagcgtcggctcatgccgtagaagcgctgtttgaaaaacggatcgccctcaatcacagttcatctcccttatcggaagaacatatcgagacggccgatctggtgctggcgatgaccgaacagcataaacagctgattgaaggccgatatcaaaacagtcagggcaaagtttttaccattaaagaatacgtgacgggggaaagcggcgatatctctgacccgttcggcggtccgcttgatgtttataaacagacgcgggacgaactggaggagctgctgacccttttggctgatcaattgcttgacgggaaaagcaagtaatctgtcagaaaatctgcaaacaggtcatttgcaaaacgaatgtgaaagagtagaatgaaatcaacggatttcgtaataaaaaggacaagcacactgggctgtcttcgcccagccacacctaggaggtaaatgaatgaaagtagctattgcgtcagatcacggcggcgtccatatccgcgaagaaataaaaagtcttttggatgaattgcagattgaatacattgatatgggctgtgaatgcggcgccggctctgtcgattattcagactacgcttttccggtagcggaaaaagtggtgaacggcgaagctgacaggggaattttaatttgcggcacaggcatcggcatgagcatctccgcaaataaggtaaagggcatacgctgtgcgcttgcccatgacaccttcagcgcaaaagcgacgcgtgaacacaatgacacgaatgttcttgcgatgggcgaacgcgtcatcggcccggggctggcgcgcgaaatcgcaaaagtctggctgacgactgaatttacgggcggccgccacgaacggcggatcggcaaaatcgcagattacgaagaaaaaaatctgtaagaggtgctggacaatggaagagatgaagcaaaaatggacggacatgctgactgagtttcaagagcaggcaggactgacggacggcagtctgctggtggtcgggtgcagtacaagtgaagccgccggaagccggatcggcaccgccggaagcggggattgggctgaattgatatacggcggacttaaccggtttaaggaaaaaacgggtgtgcatcttgcttttcaatgctgcgagcatttaaacagggcgcttgtcattgaagcggaaacggccgagcggttcaggctccccattgtttcagccgtccccgtcccgaaagcgggcggagcgatggcctcttatgcataccggcagatgcgttctccagtgctcgctgaatcgattcaggctgacgccgggattgacatcggtgatacgttcatcggcatgcatctgaaacccgttgccgtccctgtccggatatcgagccgtgagcttggagaagcacatgtgacgatggcccggacaagaccgaagctgataggcggaattcgcgccgtatatgaatgcgaatgatgaaaatacttttcctctataatgttcgtgttttctaattaaattttgtgatttttttaaataagctgttacattcacctgaaaaaccatgtacaataaggtggtaaaaataaagaacaggaaacggataggagaggatctcgctgatgaaacatttacctgtacaagataaacaagtgtttaacgccatcaaagatgagcgtaagcgtcaacagactaagatcgaattaattgcttctgaaaacttcgtgacggaagcggtaatggaagcacaaggctctgttttaacaaacaaatatgctgaaggctaccccggcaaacgctactacggcggctgtgagcatgttgatgtcgttgaggacatcgcccgcgaccgcgcgaaagagattttcggagctgagcatgtaaacgttcagccgcactcaggcgctcaggcgaacatggctgtttacttcacgattttagagcacggcgacacggtgctcgggatgaacctctcccacggcggccacttaacacacggaagcccggttaatttcagcggcgttcaatacaactttgtagaatacggtgtcgataaagacacgcaatatatagattatgaagatgtgcgtgaaaaagcgctggcgcataagccgaaactcatcgttgccggagcgagcgcatacccccgcacgatcgactttaaaaaattccgtgaaatcgctgatgaagtcggcgcttacttcatggtagacatggcgcatatcgcgggtcttgtcgcagccggccttcatccgaatccggttccttacgctgactttgtaacgacaacgactcacaaaacacttcgcggaccccgcggaggaatgatcctttgccgtgaagagttcggcaagaagattgataaatccattttcccgggaatccaaggcggaccgcttatgcatgtcatcgcggcaaaagccgtttctttcggagaagtgcttgaagatgatttcaaaacatatgcgcaaaacgtcatctcgaacgcgaagcgcctggctgagtctctgaacaaagagggtattcagctcgtatcaggcggaacggataaccaccttgtgcttgtcgacctccgttctctcggactgaccggaaaagtcgctgaacacgttcttgatgaaatcggcattacatctaataaaaacgcgatcccttacgatccggaaaaaccgttcgtcacaagcggaatccgtctcggtacggcggctgtgacaagccgcggctttgacggtgacgcgcttgaagaagtcggcgccatcatcggcctcgcgctgaaaaatcatgaagacgaagcaaaacttgaagaagcgaaacagcgcgtatctgccttgactgaaaagtttcctttatataaagaactggactattaataaggaagaaacccgccggaaccttaatccggcgggtttttttatgattttcttgaaactgtttgtctttttctgtagaatcaatagaagtgtgaaaaagtcactcggacaacaaaaaaggagctgaacacagtatgggaaaggtttacgtatttgatcatcctttaatccagcataagctgacatatattcggaatgaaaatacaggcacaaaggatttcagagaccttgtggatgaagtcgcatcactgatggcgtttgaaattacacgtgatcttcctcttaaagaagtggaagtgaaaacacctgttcaaacagcgacatccaaagtgatttcagggaagaaactcggtatcgtgccgatcctgagagcgggtctcggaatggttgacggcatgctgaaattaatcccggccgctaaagtgggacatgtcggattataccgtgatccggaaaccttaaaaccggtggaatactatgtcaagcttccttctgatgtagaagaacgcgaatttattgtcgtggatccgatgcttgctacgggaggctctgcggtggaagcgatcaacagcctgaaaaagcgcggcgcgagaaacattcgttttatgtgtcttgtagcggctccggaaggcgtggaagagctgcagaaacatcattctgacgttgatatttatatcgccgcccttgatgaaaaactgaatgaaaaaggctatatcgttccgggcctcggtgacgcgggtgacagactgtacggaaccaaataaatcggaaaacctcattcaggggttttcttttttttatccagattttagctgaatgggcagaggtcatacatttataggtgaatttgtgaacattctgtgtatgcttccggtataaaaagttttttaactttaaacagattgacacatgttaggggctattgtatgctaaacgagggtattatgagaaggttttcattcctttcatttctagtatccatcctcattttaaatcctccaaaaaaacccgttatatgaggatttatctaagcgaatgaaacagcatcccgtagcatcaggaggatgagtggttttttcgaacaggccgttttgcggacaaaaaaggccttctgcaagggttaaccgcatgttttgccgtatccaggaattatattacattttcatcaggagacagatagttgatggacgatcccaatcttacattcagcagacaacggagatatgtatttgtaatcttagcaatctatttgctgggatatggtcttacggcgtataaaactgtttttttaggcctctttttgggaactgttttcagtttgtttaatttgtggctcttgaccagaagaatgaatgcttttgacaaggccgtggcgaaaggaaagtccatacgatcactcgggagcgcagcgcgttggtgcaatgcgatacttgcgatggctgtcgcctttaaatatcccgataaagtcagtgtggcaagtgtgattattggattaatgacaatttatcccgtcattatgatagattccattattcagctcaaacgttcatcaatggaagagaggtgaaaacccattgaatcacgattacagaactattgatttgtttggtcttacttttaatctgacaaacattctgatgattactgtggcaagtgtgattgtgctgctgattgcgattcttactacaagaacgctgtccatccgtccgggaaaagcccagaacttcatggaatggattgttgattttgtccgcaatattataggcagtacaatggatttaaaaacaggggctaacttcttggcgcttggtgtaaccttgctgatgtacatatttgtatcaaatatgctagggctgccgttttctgtaacggtcggacacgagctttggtggaaatcaccgacggctgatccggctattactctgactctagccgttatggttgtgtcgttaacgcactattacggcgtgaagatgaaaggtttgaaggaatactctaaggattacctcagaccggttccgcttatgttcccgatgaagatcattgaggagtttgcgaatacgctgacactcggacttcgtctttacggtaacattttcgccggggaaattcttcttggcctgcttgcgaatctggcgacgaatttctactcaaacagtttctttctcggtttggtcggcacagtcggagccattattccgatgcttgcatggcaggcattcagcttgttcatcggtaccatccaggcatttatctttacgatgctgacgatggtgtacatgtcacacaaaatcagtcatgatcattaaaatcatatatccattcggataacattttaaaggaggaactttttcatgaatttaatagcagctgcaattgcaatcggtttaggtgcacttggtgcaggtattggtaacggtctgatcgtttcacgtacggtagagggaatcgcccgtcagccggaagcaggaaaagaacttagaactcttatgttcatgggtatcgcattggttgaggcccttccgattatcgctgtcgttatcgcgttcttagcgttctttggctaagcaaaaaagccttatatgaactaaaaatggcgaagatcactctaagagaaccttcgccattgctttatgtctgataagcaggccgtcccgaaacggctttttatcagcagagaaaacctgcagaagggagttgccgtagtagatgtctcaattacctcttgaattaggactgtcgtttaacggcggagatatcctattccaattgttagctatgttagttttattagcgcttctcaagaaattcgctctgggaccgctattaaatataatgaaacagcgtgaagatcatatcgccggcgaaattacgtccgctgaagaaagaaataaagaagcgcagaagctgattgaagagcagcgcgttcttttaaaagaagcgaaacaggaatcacaatcactcattgaaaatgcgaaaaaactgggtgaaaagcagaaggaagacattatccaggctgcacgcgccgagtctgaaagattgaaagaagcggcgagaaccgaaattgtcaaagaaaaagaacaagcggtttccgcacttcgcgagcaagtcgcatcactttctgtcttaatcgcatcgaaagtgattgaaaaagagcttgatgaacaagcccaggaacaactgattcaggactatcttaaagaggtaggagaaagccgatgagtggatctgctgtctctaaacgatacgcgtcagcgcttttcgacattgccgttgagacttctcaaatcaatgaaatcgaagaagagcttaccgtactaaaagaagtgttccgaaacgaagccggattacaggaagtgctaagccatccgaaggtatcggccgctaagaaaaaagagctgattcagcaatcgttcggcgcactgtctgagtctgtgctgcatacgatttttcttctgattgaccgccgccggtcttcgattgtgcctgatctcacagacgagtttatcaaacttgccaatcaggcccgtcagacagaggacgcggttgtttattcagtaaagccgctttcagaagcggaaatgttatcattgtctcaagtgtttgcaaaaaaagccggaatcgcttcgctcagaatcagaaatgaagtgcagacggatttaataggcggcattaaagtccgcattggaaaccggatttatgacggaagcgtaagcggaaagcttgagcgcatggaacgtcaacttgccggaggaaatcgatagaaggggtgaaacctaagtgagcatcaaagctgaagagattagcacgctgataaagcagcaaattcaaaattaccaatctgaaattgaagttcatgacgtaggtacagtcatccaagtcggagacggtattgcgcgtgtacacggccttgacaattgtatggccggtgaacttgttgagttttcaaacggcgttttgggtatggctcaaaaccttgaagaatccaacgtaggtatcgttatcttaggaccttacagagatatccgcgaaggtgatgaggtcaaaagaacgggccgcatcatggaagttcctgtaggtgaagaattaatcggacgtatcgtcaacccgctcggacagccggtagacggactgggtccgattctgacaagcaaaacacgtccgatcgaaagccaggctccaggcgtaatggaccgtaaatcggtacatgagccgctgcaaacgggtatcaaagcgatcgacgcgttaattccgatcggccgcggacagcgtgaactgattatcggggatcgtcagacaggtaaaacatctgttgcgattgatacaatcttaaaccaaaaagatcaagacatgatctgtgtgtacgtagcgatcggccaaaaagaatctacagtacgcggcgtggtggaaacacttcgtaagcacggcgcgcttgattacacgattgtcgtgacggcatccgcttcacagccggctccgcttctttaccttgcaccgtatgcaggggtgacaatgggtgaagaattcatgtacaacggcaagcacgttctcgtcgtatatgatgatttatccaaacaagcggccgcttaccgtgagctgtcattgcttcttcgccgtccgccgggccgtgaagcattccctggggatgtattctatcttcactcccgtctgcttgagcgcgcagccaagctgagtgacgctaaaggcgcaggatcaattacggcgctgccgttcgtcgaaacacaagcaggagatatctccgcttatatcccgacaaacgtcatttccattactgacggacagattttccttcaatccgatctattcttctcaggcgtgcgtcctgcgatcaatgccggattatccgtatcccgtgtcggcgggtcagcccaaatcaaagcgatgaaaaaggtagctggaacattgcgtcttgaccttgcttcataccgtgaacttgaagcattcgcccaattcggatctgatcttgaccaggcgactcaggcgaaattgaaccgcggtgcgcgtacagttgaagtgctgaagcaagacttgaataagccgcttccggttgaaaaacaggtagccattctttatgcgctgacaaaaggatatcttgatgatattccggttgcggatatcagacgttttgaagaagagtactacatgtaccttgatcaaaaccataaagatctgcttgacggcattgcgaaaacaggaaaccttcctgctgatgaagacttcaaagctgcaatcgaaggcttcaaacgcacatttgcaccaagcaactaacccttagaagatgagagaaaaaggttctctttttctctctttttacgcaaatgaagaataaaggtggtgaaatctttggcctcattacgcgatattaagtcaaggatcacgtcaacgaaaaaaacaagccagattacaaaagccatgcagatggtatccgctgcgaagctgaaccgtgcggaaaccaacgcgaagtcatttgctccgtatatggataagatccaggaggttgtgtttaacgtcggaaaaggcgcgaaaaacgcgaaacacccgatgcttgtctcaagagaagtgaaaaagacggcgtatctcgtcattacgtctgaccgcgggcttgcgggtgcgtttaacagttcggttttgcgaaacgcttaccgcaccattcaagaacgccatcagtctaaagatgaatacacggtgattgcaatcggcagagtcggccgcgatttcttcaaaaaacgggagatgccgattttgtctgagttagtggggcttggcgacgaggtcacttttgctcagattaaagatttgacccgtcagacggttcaaatgtttatcgacggcgcttttgatgaactgcatttggtgtataaccatttcgtcagtgcgatttcacaggaagtgacggagaaaaaagtgctgcctttaacggatttcggaacgagcggcgggaagcgcacggcttcttacgagttcgaaccggatgaagaagaggtgctcgaagtgctgcttcctcaatatgcggaaagcttaatttacggcgcgcttcttgacagtaaagcaagtgaacacgctgcgagaatgacagcaatgaaaaatgcgactgataatgcgaaagaactcattgattcactttcgctttcatataaccgcgcgcgtcaagcggcgattacacaagaaattaccgaaattgtcggcggtgcagccgctttagaatagaaagattttgtcaggagggatagcgatgaagaaaggacgcgtaagtcaggtgcttggaccggttgtcgacgtacgtttcgaggacggccacttgcctgcgatttataatgcgattaaagtttcacagccagctacaggcgaaaatgaagtaggcatcgacctaacgctagaggttgctcttcatttaggcgatgatacagtccgtacaattgccatggcatctacggacggaattcagcgcggaatggaagccgttgatacaggtgcgccgatttccgttccagtcggtgatgtgactctcggacgcgtatttaacgtactgggagataaaattgatttaaatgaaccgctgcctgcggatgctcaaaaggacccgatccacagatcagctccttcattcgatgagctttcaactgaggttgaaattcttgaaacggggattaaggttgttgacctgctcgctccttacatcaagggcggtaaaatcggattgttcggcggcgccggcgtaggtaaaaccgtattaatccaggaattaatcaacaacatcgcgcaagagcacggcggtatttccgtattcgccggtgtaggagagcgtactcgtgaagggaacgaccttttctacgaaatgagcgattcaggcgttatcaagaaaacagccatggtcttcggacagatgaacgagccgccgggcgcacgtatgcgtgtagcactgacgggtcttacaatggctgagcatttccgtgataaacaaggacaggacgtactgttctttatcgataacattttccgtttcacacaagcgggttcagaggtttccgcgcttctcggccgtatgccttctgcggttggttatcagccgacgcttgcgacagaaatgggtcagcttcaagagcgtattacgtctacaaacgttggttcagttacatctatccaggcgatctacgtgcctgccgatgactacactgacccggctccggcgacaacgttcgctcacttggatgcaacgactaaccttgagcgtaaattaactgaaatgggtatctaccctgcggttgatccgctggcttccacttcccgcgcgcttgctccggaaattgtcggagaagagcattatgcggtggcgcgtgaagttcagtcaacgcttcagcgttacaaagaacttcaggatattatcgcgattctcggtatggacgaattaggtgaagaagacaagcttgtcgttcaccgcgcacgccgtatccagttcttcctttctcaaaacttccacgtagctgagcagtttacgggacaaaagggttcttacgtgcctgttaaagaaacggtacgaggctttaaagaaatcctttccggtaaatatgaccatcttccggaagatgcattccgtcttgtgggacgcattgaagaagtcattgagaatgcaaaagagatgggtgtagaagtttaatctggtcctaggagggtaaaagcatgaagaccgttaaagtcaatatcgttactcccgacggcccagtatatgatgctgatattgaaatggtgagtgtaagagccgagagcggtgatctcggtatcctgcctggccatattccgaccgtggctccgcttaaaatcggcgctgtccgccttaaaaaagacgggcagaccgaattggcggctgtcagcggcggatttttagaagtccgtcctgatcaggtcactatccttgcacaagccgctgaaacagcggaaagcattgataaagagcgcgcccttgctgcgaaaaagcgggcggaagaccgtttgaacaaacgatcagatgatactgacattcgtcgggctgagcttgcgttacagcgggctgtaaacagattggatgttgcaggaaactaaaaaagaatccttctcggctgtctgagaaggattctttttctatattaacgcataagagattcatagacgccgataagcggatgatcctcttctttttgcagatataaatgttcgcagcagttgtcggtgtgccacgttttgtttcctctccgcacacccgtcgtataagcgccgtccgtatacggataaggtttgacgacccattcggcatcgtcatgatgtctgatggcgcaatcgatgacatacacactgagcattttctcaaattcgtcaatcggcaggttccaatccgccaaaagcagctcttttatgctgcggaagtaaagagcttccactgccagcaggctgccgggtgaataatcaagagaaatgttgaaaaactgacataattctttcagttcctctgtttgagactgtctataatcatagtagaatgctatcgcttcccactcgtggtcaaatacgggaagtgtttctccatactgcttttccggatgaaaaaaggaatgattcatattcccatctcctttccaaaaaagtatatcatgccggagaacggacatttaagcggggattgcccctaattttggataaaaattctgatgtaaaaatgatcatctttctctcttcttcttatataataagagaggatatgaggggcggaaaaaatgaaaggagatggaatttgtgaatgtattggggcagcaggccgcaatcagcatcctggttcacctggtatgcattgcggtgacatggtgggcgcttcaggccgtcaactttgatccgctgatccgaaaaggaaaaatagtgcaggcgaggctgctgatcattcttcttaccattgcgatcggtacggcagtcgccaacttctttttagattatcttacctattcgaaacagcttccatacttattttaagatgtttcgtctgttgaaatgaagggaatcgctgggtgagaaaccaatttttcttcacccgcttggcgagttttgacgaagttttccatgtattgctttccccggctccggcaaaaatgggagtaagggggagagatcgatatgaagaaaaaaagagcaggccgtatcatcttgttttttgtttttttaagcgccttaatagcggtatttcattccattcatgcaagtgagctgtctccgcttgcccagattgccgaaggaatggagcggcagcaggtcactgtggatgaatggacgcttcatgcgaaaaaaaatctgaacctgtcactgagtgaatttgatgacaaggtaaaagaactgaagacgcagtatccgcaatatcattgggaatccgcgcgggaagataaaatcgtaaaggccgtcggcacgtattctgacaaaaaaaatcacacaacttttaaactgcagctcgtcactaccctcaaaaaccagaacccaacttcgtatttattatatgagcaaatgagcccggagcaaccggaaaactggaatgatacatatgaacagtttgaacggcaggcacatgacatatttcaaaataaagtatttatttttacttgtctaaagggtcatttaaatgataatatgagtattgttttgcaaaaaaaagcagaacagctcatgaaagaatttgaagcaagtccagttgaacatgtagttgagcctcatttcgtttctgtttctgcatttacatataagtggacagattacatcatgacatcgaaacataagatgaatgtgcaagttgcgcttagaagtgcgggaatgggcggaaaacataccgttacggttggcacaccaatcgtgacaactgaatattaatatagagaatatagggacgcggaggggaataccttggaaaaaatcatcgtccgcggcggtcagaagttaaacggcacagtgaaagttgaaggagcaaaaaatgccgttttaccagttatcgctgcatctttattagcaagtgaagaaaaaagcgtaatatgtgatgtacctacgctctccgatgtatatacaattaatgaagtgttgcgtcatttaggagcagatgtgcattttgagaataatgaagttaccgtaaacgcttcttacgctttagaaacagaagcaccttttgaatatgtgcgcaaaatgcgcgcgtcagtgcttgttatgggccctctgttagctcgtacgggtcattcaagagtagcgcttccgggcggttgcgcaatcggctcaagaccgattgatcagcatttaaaaggctttgaagcaatgggtgcaaaaatcaaagtaggcaacggctttattgaagcagaagtggaaggccgtctgcagggcgcaaaaatctatttagatttcccaagtgtgggtgcgacagaaaacttgattatggcagctgctttagctgaaggaacaacaacgcttgaaaacgtggcaaaagagcctgaaatcgttgacttagcgaactatatcaatgcgatgggcggaaaaatccgcggagccggcacaggcaccattaaaattgaaggtgtcgagaagcttcgcggcgtaagacacaacatcattcctgaccgtattgaagcgggtactttcatggtggctgcggctatcacggaaggaaatgtattagtcaaaggtgcggttcctgagcatcttacgtctttaattgcgaaaatggaagaaatgggagtcaaaattacggatgaaggagaaggccttcgtgtcatcggtcctgcccagctgaagccgatcgacattaaaacgatgcctcacccaggattcccgactgatatgcagtcgcaaatgatggcgctgcttctccgtgcgagcggaacaagcatgattactgaaactgtgtttgaaaaccgttttatgcatgctgaagaattccgccggatgaatggcgacattaaaattgaaggacgttctgtgatcattaacggtcctgtacagctgcaaggcgcagaagttgccgctacggacctgcgtgcgggcgcggcgctgattcttgcgggattagtggctgaaggtcatacacgcgtcacggaactgaagcacttggatcgcggttatgtgaatttccataaaaaacttgcggctctcggcgctgacatcgagcgtgtcgttgatgaaacggccgctgaacaagaaagcaaagaagtcgtaactgacctaaacgcataatggctgtaaaaacagtatgtcaatctggcatactgtttttttatggtttatcatcattattatgctctgattttcaaaaaagaatacgtttttcgcgtgaaaaatggaataagattctgtccaaaaggaagtcatattagcttgtccctgcccataagatgaagtagagtcgaatcccaagcaggaggcagctgatatatgaaaccgattgtatttctactatccgggctgtgtatacttattcttcttgttcccaccattctcgttcttccgtttcaggcggaaaaaggagcagccgtaaacagagagcccggacacaaaacaacacacaccacacgagaaacaaaaggagcagaaacattgaaagaatcacctgtatccattccggtttatcggacatccaatcattctgtagagaacattccgcttgaagagtacgtgatcggtgtcgtggcttccgaaatgcccgcaacctttaaaccggaagccttaaaagcccaggcgctcgccgcccggacattcatcgtcagattgatggttgctgactcagccgttcaggcgccgaaaggatcactggtggacgatacgcaaatgttccaagtctatcaaagcaaaagccagctgaaaaaagaatggggttctaagtacgcacacaacctcaagaaaatcacaaacgcggtcgcaggcacgcaaggaaagattttaacgtacgacaacaagccgattgaggcatctttcttctctacgagcaacgggtatacggaaaatgcggaagcctattggacaagcgccattccttatttaaagagcgtgaaaagtccgtgggataagcaatcgccgaaatatcttgccacccagaccttcagtgtgccggagtttcagcaaaagctcggcgtacagctctcgggacaaaacacggtagggcagattacagccagaacgccgggccatcaagtggcgacggccgtcataaacggcaaaaagctgaagggaagagacatccgggaaaaactcggactccgttctgccgactttgaatggaaacggaacggcggcagcatcaccattacgacaaaaggattcggccacggcgtcggcatgagccagtacggggccaattacatggcggagcaggggaaatccgtggcggacatcgtcaagcattattatcagggagtggacatatccgaagcagattcatttttaaacaaatatatggcgaaaaaataggcgctttcatgagcgtctgttttttttgaaaactattccataaacggtaaagcaaccaacagactcatataacgaaagcctaaaggctgacaaatgccgtctgaaggctgagcgccgggtgaaaatcactgataaaaatgccgtatctatgtgaatatacgcaaaaataatgaggaacgccgtcctatttatttcccttttcatctcatttacgataaatattgttcggcgttgaacgtaaatctattgaaaaggggaagaagcaatgaaaaaaacactttcactcataatcatgctcggattgatgctgactgctgcatctcctgcttttgctgccgagaatgcaaacgagaagacatttttatttaaaaacaatatcgccattctgcttgatgcgagcggcagtatggcgaaacggattgacggcgtttctaaatacaatatggcaaaagatgaaatcgtccgttttgcagatcgaattaagtctacatcacaggtcagaatgacggttttcggttcggaaggcaataataaaaactccggaaaagttcaatcttgtgaatccattcgcggtgtatacggattccaaaagtttgacagacagagcttcctcaactctctgaacggaatcgggcctacgggctggacaccgattgcaaaagcattagaagatgcgaaggcttcttttaacggcgttcataaattcggctttaaatccgtttacctgttgacggacggtgaggagacatgcggcggagatcctattaagacagcgaaagaacttcgcaaacatcatattaaagtcaacgtgatcggctttgactttaaagaaggcttcaacggacagcttcacgcaattgccggtgcgggcggaggaaaatattacgaagctcacagccaaaaggatatgaaccgcatctttacgatggaagcgagttcattagcgaaataagaaaaggtgccgtttagcggcccttttttttatttttatttaacaaaaatttcaagaaaagatgaagagaaaactgtaaaaagaatcagattccggacttatattacaaaaagggcgaaaaaggcattaaatctgtcatcatttatccaatctttttaggatgatgcgcataattctgttcatttttaacggcgtacagccgcttatacaaaaggaatcccgccctatatctttttgcatactcctcatctagcatagagaagagccgggggcccatcggccaaaaacaaacggagaggaatgaaggaaatgaaaaaaatgttcactgcggggattgtcggacttttgacgctttcactcggatcacctgtttttgcagctgagaaaaagcacgaagaaacaaacgtcgccgtgctgtttgacgcaagcgggagcatgatacaaaaaacagggggagagcgtaaaatagatgttgcgaaagagtctgtcacttcttttgcggaagttcttcctgaagacacgaatctgatgcttcgggtattcgggcataagggcaataataaaaactcaggcaaagccgtatcatgtaacgcgacagaaacgttatacggccttcagccgtacgccgtgactccatttgagcaatcactcagcaagattaaaccgaccggctggacaccgatagcgaaagcgctttctgatacacgtgaagaatttgagcgggccggcgctaaagggaaaaacgtcgtatatctgatcacagacggtgaagaaacatgcggcgggaatcctcaagccgaaattcaaaagctccgtaaagcgaatgtcaacacggtcgtcaatatcatcggcttcaacttcggcatgaaaggaagcgaaagccttgaaaaagcggcggaagcgggaggcggcacatacgtctcagctgacagcgcggacgagttcaaacaggcttgggaagacgccgcaaaggatttagcaaaagaataggttaaaaaaggacgcccgtgcggcgtctttttttgtttagaaaacggaaccgcgggaatgatacggataaaaggagatgaacgctgttgttaaaaggagcaggcattatattggtgctggcggcagtcgtttttgttctgatagggatttttctgaagcttgccgccttcatattcgtcagtatattggccattatcgccgcagttattttattcaccattctgagcagacatcatcgcaatgaaacatagagtccgaagagggctctttttttaaaccgcaaattcgacaaaatacagggattgtggaagaataaaagagaaggatactgcggaggggaaaacagtggatgaaaaaacaacagcggtaagagacatataccgctatgaaaaaggggtattaacaaagacggcagatcggatggtttcagagtatccgcttaccgtcatggtgaacgggcaggaatttgttacgctcgtctgcacgcctgaccatttagaggaactcgtcatcggatttctcgcatcagaaggcgtcattcgttttgaaaaagagatcaaaagctttactatagatgaaagtctcgggttcgcatatgttgaactgacgaatcccggagtgcttgagcaaaaagactatacgaagagggtcatcggttcatgctgcgggaaaggccgccatttttactttcagcaggatgtgaaaacggccaaaaccgccgtcagccggattaccataactcctgagacgtgccttcgcctgatgaaggagatgcaaagcggaagcggcaccttccgggaaacgggcggcgtccataatgcagcgctgtgcgatacggaaaagctgctcttgatgaggacggatatcgggcgccacaacgcgctggataagctgtacggctgctgtttgaaaaacggaatgcccgtccgtgacaagctgatcgtcttcagcggccggatttcctcagaggttttattaaaagccgcaaaaatcggcgtgtcgattgtcatttcaaaatcggcgccgacggagctcgcgctgcaaatggcggaagagctgaacatcaccgcgatcggttttgtcagaaacggatcatttaacgtatacacacatcctgaacgggttgaacaatagaaaggggtcttgggcttatgaatacagaaacgcgccgggtgacagacaaaaaggaaaggccgctcagggatcttcgtatctctgtaaccgaccgctgcaacttcagatgcacgtactgtatgccagccgaattattcggaccggattatccatttttacaaaagacggaattgctctccttcgaggagcttgagcggcttgcgaagctgtttgtcggccgcttcggcgttgaaaaaatcaggctgacgggcggagagccgctcatgagaaaagatatgcctgaattgatcaaaaaacttgcgcgcatcccaggacttaaagatatcgcgatgacgacaaacggctctctgcttcccgtgtatgcggaaaaactgaagcaggcggggctgcatcgagtgacagtcagcctcgattctttagaggatgagcggtttaaggccattaacggccgcggcgtttcggtgaacaaggtgcttgagggcattgaggcggcaaaagcggccggactcggtgtgaaaatcaatatggttgttcaaaagggcgtcaatgaaaaagatatcctgccgatggcccgctattttaaagaaaaaggtcatattctccggtttattgaatttatggatgtaggcaatacgaatcaatggaataaaaaagacgtgatcacgaaggccgaaattattgatctgatcaaccagcacatgccgacggagccgatagaagcgaattacaaaggagaggtcgcttccaggttccgctatcttgacggttccggcgaaatcggcgtgatttcctccgtctcggatgcattctgcgcctcctgcaacagagcgcgcctgtcggcgagaggcgagctgtttacgtgcctgtttgcgtcaagcggctatgatgttcggaaactcgtgcgcggcggtctgaccgatgatgaattgacggaatccatcgcttctgtctggagaaatcgcgcggatcagtattcaattgaccgcgcgctttctaaaacggatgggaaaaagaaagtggaaatgtcttatataggcggatgaagaaaagcttgcccggacaagggcaggcttttttattcacaatatgagagcggtctgttcaaaaaataccggtaacagccgaaatatatgataggaattttgatgcaggacaatcaagttatgcaattccaaagccatacaatatgttaaaatataaccaatagaaattagaaaaggttgtgaaaggggcatgaccgcatacgagattccgtcatctcaagttggagtcaagatcaacaaatggtacaagcacattttagcgtttcaagcggctgatgccataaagctgaaagaggaaattgatgaggatatacaacgtatggaggaagaccagctgctgctgttatattatcagctgatcagctaccgccatcatattatgcttgattacgtcaagccggaatgcaccgaacaatcacagattcagtacagcgagctgcaaaagacgatcgaaagcacggacagcatatcgggactgtctgagtattatttccatttgttcagagggatgtatgaattcgatcacaataactatgttgcggctatttctttttaccggaaagcggaaaaactcctttcatttgtcgaggatgatatagagagggcggaattccatttcaagatgtctgaagttttttacgtcatgaagcagactcatttttccatgaatcacgggattcaggcgctggatacgtatatgaaacacgatttttacagagtgcggagaattcaatgccatttcgtcatttcaggaaactacatcgactgcaaaaactacgacaaagcgcttgagcatttagacgaagccctccgcctttctttgcttgaaggacagccccgcctgatcgggtcttcgctttacaatctggggaattgttatgctgaaaagcgggatctggatgaagcggcccggtactttagaaaagcggttcccgtttttgaagagcatcagcttgaacagcttccgaaggcgctgttcagcttaacgcacacccttttcaggctgcatgatgaccaagcggcccttacctattatgaaagagggatcatgatcgcgaaagaacgcggcgaccgattcagtttagagaagtataagtttttacaagcgctttatttggagtcactcaatatggatttaatccatgaagtgtttgactatatgaatgaaaaatcgctgtatgtgtatattgaagatttcgccttggaggccgccgtttacacaagcgcacatgagcaatataaagaagcggcgtatttttatgaaaaagcgattcgcatgagagaaaaaattcaaaaagaacagtgtttatacgatatataatttttgttaaccatctgatcagcagatggttatttttttatgcacatcaggacgtttgatcatagaaaaaatcggaaaaatcgcaaaagagggaaaaaagtacgatgggaaggagggatttgttgttcggatttaatgatatgataaagtttttcgtttcatttctcatcattctcccgatggtgtctgtcatccatgtgtcgggacacagctttatggccatgctgttcggaggcaaggcgtcgttggatatcggaatggggaaacgtcttttaaaagtagggccgattcaggttcggcgtatctacttcatagattctttctgcaagttcggcgaattgcggatagataaccgtctgacgagcgcgctcgtctattccggaggctgtctgtttaatctcgcttctatctttttaataaatctgctgatcataaaagatttcctagagccaaacttatttttttaccaatttgtctatttttcaacttattatgttttctttgctcttctgcccgtgcaatacggggataataagctgtcagacggattggccgtttacaaagtgatccgctacggggaacgctgtgaaatcaataattgagagttgaaatgtttgctatcaggctgaaagggaagaaaacaagtacacaaaaacaaaaggagctgaagagatcatgagtgaagataacggtttaaaagacaaagtaaaaggcggcatgaacaaaataaaaggggaagcaaaggacaaagcaggcgacatggcaaacaagtccgacttaaaagcggaagggaaaaaagacaaagcgaaaggcagcctgcaaaagggtgtcggtaaaacgaaagataaactcagtgatgattaatttgatcgtgaaacacagcaaaagcccaaaatattttgggctttttgttatgagaaatgacaaaaattccagttcgtttggttaatattcactaaatttttaaatattctataaattccccggcgatttctttataatattcacaaagaatgtaacctttcttcacatttaattaaacgtttgttgaagaaaaaaatgagaaatcggtcatttctgcaaaaggaatcgggccgttcactgtcgaataacttttatcacttaacatttcatgaggtgaagggggtgacggccgcctgcatcgtttcggtatgaccatgcggattgtgtttgactatcactaagggggaatacagatgaaactgacaccggttgaacaagaaaaattgcttatttttacggcgggagagctcgctaagcagcggaaggcgcgcggcgttctgctgaattatcccgaagccgccgcatatttgacctgttatctgatggaaggcgcgagagacggaaaaagcgttgctgagctgatggaatccggccgcaatgtattgacggaaaaagacgttatggaaggcgttgcggaaatgctggacagcattcaggtggaagcgacgttcccggacggggttaagcttgtcaccgttcatcagccgatcaaagcggaggtgaagtcatgaagccgggagcgattcaagtcgcaaaggggaccatcaccattaacgaaggccggaagacgctggaggtgtcagtcaccaataacggaacacggtcagtgcaggtcggatcgcattttcattttgccgaagccaacggcgccctttccttcaatcgggacaaagccatcggcatgcgccttgatatcccgtcaggcacatctgtccgttttgaaccgggagaagagaaaaccgtcacgctcgtggaaatcggagggcgaaaaacggtcagaggcctcaacggcatggccgatacgtatatggatgagcggggaaaagagaagacgctgtcaaatcttaaaaaagccggatggatggaggaggcgatccgatgaaaatgtcacgtgagcaatacgcagaactgttcggaccgacaacgggagacaaagtcagactcggagatacggatttatggattgaagtcgaaaaagatttcacgaattacggggaagaaatgattttcggcggagggaaaacaatccgggacggcatggggcagaacgggcgtatcaccgggaaagacggagcgcttgatctggtcattacaaacgccgtcatcctggattataccggaatcgtcaaggcggatatcggggtgaaggacggccggattgtcggcgtcgggaaaagcggcaaccctgatatgatggatggggtggacccgcacatgattatcggtgccggaacagaagtcatttccggcgaagggaaaatcgtaacggccggcggggtggatacgcatatccactttatctgcccgcagcagatggaagtcgcgctttcttcaggcgtgactacgcttctcggcggcggaacaggtcctgcgacgggaagtaaagcgacgacttgtacatccggtgtatggtacatgtcgagaatgctggaagcggccgaggagtttccgatcaatgtcggtttcttaggaaaaggaaatgcatccgataaagcgccgctgatcgagcaggtggaagcaggcgcaatcggcctgaagctgcatgaagattggggatcaacgccaagcgccattaaagcttgcatggaagcagcggatgaggcggacattcaggtggcgatccacacagacacgataaatgaagcgggctttttagaaaatacgcttgatgcgatcggcgaccgggttatccatacatatcacatagagggagccggcggaggccatgcaccggatattatgaaactcgcatcttacgccaatatcctgccgtcctctacgacgccgacgattccatataccgtcaacacgatggacgagcatcttgatatgatgatggtctgccatcatttagattcaaaagtgcctgaagacgtggcgttcagtcattcacgcatcagagcggccaccattgcggcggaggatattctgcacgatatcggcgcgatcagcatgacgtcatctgactcgcaggcgatgggcagggtgggagaagtgattatccggacatggcaggtggccgataaaatgaaaaaacagcgcggcgctctatcgggagaaaacagcaatgacaatgtgcgcgccaaacgctatatcgccaaatacacgatcaacccggctgtcactcacggtctgagccatgaagtcggttccgttgaaaaaggaaagctcgccgacctcgtactatgggacccggttttcttcggcgtcaaacctgaacttgtgctcaaaggcggcatgattgcccgcgcccagatgggagatccgaatgcttccattccgacgcctgagcccgtgtttatgcggcagatgtacgcatcatacggtaaagcaaaccgcaatacctctattacatttatgtcccaggccggtatcgcaaacggtgtgccggaaaagctcggccttgaaaaaatgatttctcccgtacggaatatccgtaagctgagtaagctcgacatgaagctgaatgacgcgatgccgaatatacatgtcgatccgaaaacctatcaggtgttcgccgacggagaagagctggcatgccagcccgtcagctatgttccgctaggacagcgttatttcttattttaatccctctccggccggtttcccgccggcctgtttaccctctattgccaacttgatttcatcctgccgcccgttttagtgtatattagtagttgacaaacaaatgaaatgtaactattttggttacaatggtggtgaaaaacatgattaacagccgtcttgctgtggccattcacattttatcgctgatctcaacggatgaacgggcgtcatcggacatgattgcgggcagcgtaaacaccaatcccgtcgtagtgcggagaacgatcagccagctgaaaaaagcgggtattctgacatcccgggcgggtgttccgggagccagcctgaaaaaagatccgtcggagatcaccctcttagaggtttacagggcggtgcagaataaggaagagctttttgcggttcacgacaatccgaatcccgactgtccggtcggcaaaaatattcagcgcgcgctcgatgagacgttcggaagcgtacagcgggcaatggagaatgaacttgcgagcaagtccctttatgatgtaatgaatcatctcttttgttaaaaagagatgggttcatgccgctagacgtgtaacggaaatggttacaatgggtaatgaggaaatcacggttttggctccatattcagacaagcctggatgcgggattgcgatctgtttaatgaagaaaacctccgaaactaaaggaggtggtaaccgggatatttttattttgcttaaggcttatgtgaaggtgtctgttgtaagcgggttaccaaaaaaagacggaactcttattttaatacgcgctaaaaaaactgatggagaatatcctgcctccggtaatgccaaaaccgttcgcctcttcacaatcattataaaatttctcaaggaacgatcagcagcccgttagctgcccctcattagagatgagctgttaccacactgttacattagaacttccgctgcttttatatccttctgtcgctaagacttgataagcccaattactgcccagattcattccatggctcttccatgcgttaacatgattgctgaaagtgattgcagcgttgcttccggtcggtctcttcgactggcggacactccagtactgcgtaaaagtagtgttatcgccatcaatggaaggtgcgttataacgtgtcgttgtatatatgtcatatgtacctccatcactctttacggtacctttatacgttccggtaggtctgtaagtaccccatgaatccaccacataatattcgatgaggggcgatctcgtccagccatataaagtcaaatatccattgccgttcggcgcccaaacaccggcattatagtttattgttctaaatggcgagcctgtagtccagcctttaccaacaacgaaattcccggtattagaccaattaacactgtaatttccgccagagccattgactgcgtttactgttccgcccccgtcagtccaattttgccagtaatctgtgccagctgcagaggcggttgccgaaaacatgctgatactcatgaaagctgccgttaatcccactaagaatttctttttaaacttaaacatatgttacctcctatactattttttctgactttgacatgaggcagcactcgtaaatatttaacgaacgccaacgcttttgatcgttcctttcaatataatagcatgaatacatgggtgaatattaagaacaattgtaatttaattacaaagacccaaaaaattgtatgatgagtggtcttgtaccgccatagccttatttcgcagaactcagtgatttcagttaaaactctgaggaaacgttttatttgaaaaaacttttttgccgaaagaatatctgcatacagcgtcaatgctgttcgccgtattggcaaatccgaagcagaaaaactttaccgttgtcggagaagcggaataagaaaaaatcccgggcggatgcgccgggattttcctttttaatatgtattggcatcaatattattaaacgcgtcgtccacgatgccgagcgtcatgaggacaatgaaaagaacgataccgagaacggacaagccgaccgtcacgatcagatagatcccctgcattttcacgaactttgcataattctccagcatatgttcctctgtcagttcattgaactgcgccgccatctgtcccgcttcatttgccgagcgcatcagaaaaatgccggcaatgatctgcagaacgccgggaatggctccgattaaaaagaaaaacgcgcccgaaagcgccgcaaacgcgcctataataataaacaaaatacctgtcgcttttccccatttcgaaatagaaataagcgaacgattcactgattcaggtttcaaaccatggcactcctttacaaaaaaatactcacttttcatttatacactattcggtcattcttttgaatataaaatgtgttttttcaagctgtgtccgtttttatatcagaaaattcccgagaaacatcccgggaattacaaaatcggcgacagaagccttgaaatcgattctttaatgcggatccgcagcgaacgctcctgatattcttcatacgtatattttctggagacgagcagatcttctttaaatgaggaaatgagttttttcgcgatggtgacgtcataaataaaggcgttgacttcaaaattaagtctgaagcttctgacgtcgatattcgccgtaccgactgaagccgtctcatcatcgacgacaatcgtttttgcatgaataaagccgttatcgtaaatgtagactgaggctccggctttcaaaagatcgccgatgtaagataaagtcgcccagtaaacgaaagcgtgatccggcttgttcggaatcatgattttgacgtcaatgcctgacagacaggcgatcctgagggcatccaaaagacttgagtcaggaataaagtaaggcgtctgaatcaggatcgaccgtttggccgttgagatcatcttgatatagccgtttttaatttgttcccattctgaatccggtccgctcgtgacaatctgcatcccgacattgcccttcggctcgcattccggaaaatgattcggaacgtaagtgagcgtatggtgatgggaagcttggttccaatcgagaataaaccgtgtctgaatggcgtgtaccgccgtgccttgaagtctgaggtgcgtatcgcgccagtagccgaatttcggattcaggccgagatattcatctccgacgttaaagccgccgacatagccggtttcgccgtcaatgatgacgagcttgcggtgattccgataattgagccgcaaattaatcggacgaagcctggaaggaaaaaagacttccacatggccgccggcgtcccgcagcggtttgaagaatttttttctgagtgatcttgaaccgagttcatcatataacactctgacctttacgccttcccgtgcttttttcactaaggcatcgcgcaatttttttcccagttcatcacctttataaatatagtattgaaggtgaatgtgatcttttgcgttggaaatgtccttcattaagcgtttgaacttatcgcgcccgtccgttaaaatctccaccgaattatcctctgtaaagactgcgtggttgttcatgacaagcatatagatgaggtctttattatccacagtcgccctgttgttaaattggaattgcctcgacttcagatctttcagctgaaacttcagcagcttttctattccgatttttttacggtcttcccattgaaacaggtgcttgcgtctcaggttatggccgaataacaggtataaaataaaccctaaaatgggaataaaaaaaagaaccaagagccaagcccatgaagcgctggcatcgcgtctttctttgaaaatcatgatgacggccaaaagtatatttaaaacgaaaaaaaatccgaataaaataaatgaaatgctcactttgcaaccccgctatatcatatttatcaagactgtgcccattagtattccgacaagtgcagcaatctgattcccatttcaaattataacattgacattttgaaagaataaagagccggaatcaaagatgaatgcagttttctttcaaagaaagttccgggtgcggtaaaatatgcatatatgaaaaagaagacaaaaatgacagcaaaggggagagggcatgaagctggagcatgcggaacaattgccgggattcataaaaaaagaaattcagaaaatacaaatcgccatcgcgccgctgatgaaaaaaagcatcatttaccgttttcttgctttcccgctcgccgcttttagtctgtttcatctggcatcgcttttgattcaggccccttccgggagaggagctctcgtatcggccggcatttttgccctccttgcggctctgggtcttgcgttttttaaggaagccggctatcagcggaaacaggtgcaaaaaacgatccggctttatatgctgaacagaatcagaaaaagcgatattctgtccgaggaacggaaaagcgcctacacccggctgattgccgaggagccgtctgcgatgaagagctttattgaatttttaacggaagaagaccggaaaaaagaaatgctgtattaaaaaagagctgacgcgcgatcagctctttttgtcattcaaacacaggatcgttctcatagtaatatgaatcaggcgtgtcatacgtatcagtgctgtaataagccataattccgatgacagcgaagatgacgactaaaataaaagcgagaatgcccagtaccacactggatgccgcgtaaaaaaactgcattttgataaatgacgcataatgtgcaagcatattttcttccgcgttttcttctagcccttcctgaagggcggcagccgcttttgccgagcgcatcagcatgacgccggaaatgatgagcagaacacccggaatggctccgagcagcgtcacaatggctgacagagcggaaagagaacctgtgatgatcagaaacacggcggtgatctttccccatttggcgatgtcggcaagggaacgggcttttttattgagcggctggttttcgtctttgtctttatcgatggtgatcatgacagttctctccctaaaatgttcaagtcatatcgttttccgtccatttcggcgatacccgggaatacgccccattcggtaaaaccgaatttttcaaacagcttaatgctcggcacattatgtccgaagataaaagccatcaggctgcggatgccgattgccggagcgagtgccagggcttctttcagcagaaagcttcctgctcctttgccgcggcaatcctgatgcagatagatgctgatctccgccgttttgtcataggccggacggccgtaaaacgtttcaaagctgatccaggccgccactttgccggtttcatcttccgcgaccatcagcgggcgccggtccgtgtgccgcaaaaaccaatccatctggtctgcgggcgtcacttcttccgtatcagccgttaccattcgtgaggcaatcgtcgagttgtatatggccaccaccgcatctaaatcctccaatacggctttgcgcagggttaaattcatattccgggatctcccttcacatttcattacataattaagtgcaatctgcacatactacttctaaaaaagttttttatggatgtgtatatattttcagaaaagtgttcagaatgttgctgaggtgatgaacaaatgagagaggaagaaaagaaaacttctcaagtcaaaaaacttcagcggttttttcgcaaacgctggatattccctgcaatctacttagtcagtgcggccgtcattttaacagctgtcctttggtatcaatccgtttcgaatgatgtgaaggacaatctgacgaacaacggcggaaactccgcgtatgacagcggcaaagacgatgccgtcgaagtaggcaagtcaatggaaaacgtcgcaatgccggctgctcattctgaaaatgtttctgttgtgaaaaagttttacgaatctgatgccgcaaaaaaagagaaagaagcagcacttgttaactataataacacgtacagcctcagtaaaggaattgacttagctgagaaagacggaaaatcatttgatgtttctgcttctctgagcggtacggttgttaaagctgctaaagacccggtactggggtatgtggttgaaattgaacactcagacggcctgtctactgtctatcagtctttatctgaagtcagcgtggaccagggcgacaaagtaaagcagaaccaggtcatcggtaaatccggaaaaaatctttacagtgaagaaagcggaaatcacgtgcactttgaaatccgcaaggacggcgtagcgatgaacccgctcaattttatggacaagccggtaacatctattgaaaaagcggcggctgaagagaaaaacgctgtgacagaagaaacggaagggtcaattcagcagtcttccgagaaaaaagatgtgacgcctaaaaaagaaaccgaagaaaaaccaggtgacaaagaagacggcacaaaagacaagacagatggtaaagatgacggctcaatgaaagattcgggcaagtaatcttgatcccaaagcgtctatcagctctgataggcgcttttcatattgctgcatgtgcctttatactaatagaaaacgaaggagatgctgaatgaataaatgtctggcggccgggtggctcgtctttgttttcgtttctgctttgactgaaagctttcacgatatgattgtgtcgcagacggtgtccttccgtttcacgtcccatccggatgtgtccggtttctttgtgttcgatatggcggagctcgccataccggaagcggcgattcaaaagctcgggcacgcgttttcattttttgtgctcgcctatttgtttttcagggagcgcaggcgcatgaagagggcggtgctgtatgcattggccgccgctttcctgacagaaatcgtccagctctttttcggcagaaacggatgcctccgcgatgtgctgattgacagtctcggcattgccgcattctgggctttacaaaggaaaaagcatacagccaaacatacaaaaaccggcagtctgtgacagacgccggctttttttatatattatggtttgtcgatttgcttttatgaacgatactttcatagattcgcacgatcagatcgacaatcggacgaagcacatttgaaaatctgaacagcaggaatccgacaatgagggaaacgataatgcttccgagcacatcgatcggataatgatggccgacccaaattcttgagaagccggtcaaaaggccgaaaatcacaagcggccagccgagttttttgttgcggaacagaatcgcaattgaaatcgccaaagcgcctgtcgtatggtcactcgggaatgaagcatccgcggcatgagggatcagcgtatgaaccgtatgctcgacaaaggggcgcggctcgacatagactttcgtgatgaggtagttgatgataagcgccgcaacacccgtgaagcccgcgtacagggcgttttgtctgccttttgtgcttccgaacagccacatggcaagcaggaaaagggcgtaggcgtaaatggcgtattccgttataaaaaccatgatagagtcgagaatggcactatggtgcgacaaaccattgatcgctttaaatagttcgtaattcacaaatatcaccttttatctttattttatatgaacagtgtaatgcttttttctatgagacacaattggtattaaaaataatcataaaaaagtaaacagaatgaaacgtgactgtattactgtgcgtcaagtatgcgggaaaagaatagccgaaggagttttgtccgttgctgaaacgtttgaaaaacgccgatctgccgcttgtgtttgtcattatgctgctttgcggattcggcttgttaatggtgtacagcgccagtgatgtgatggggtctcagcggtacggagatccatcctatttcttccataaacaaagtgcctctttactgatcggattatgcttatttctatttgccgcctgtctgccgtataagcggtatgcgcggcttgtaccgctgtttgtggtcggttcgctggtattgctgctgctcgtattgataccgggaatcgggctggagcggaatttttcccgcaggtggctgggagcgggcccgcttgtcgtacagccgtctgaattggcgaagatcgccatgattttgtatttcgcttcggtttatacgaaaaagcagccgtacattcatcaatttgtgaaaggggttctgccgcctttagtaattttggggaccgcttttctgctcactttggcggagcctgatttagggacggcttccttaatcctggcggcgtgcgggtcgattttattatgtgccggcttgaaaaagcgccatcttttcgtgctcggcgcgacggcggtgtcgggggttgtttatctcgcattttctgcatcctatcgtgtgaagcgcctcgtttcctttaccaatccgtttggtgacgcgaacggggacggctatcagctgattcaatcctattttgctatttccggaggcgggtttttcggaagagggcttggaaacagtgttgaaaaaatgaactatctgcctgaggcgcataccgatttcattatggccgtgatcagtgaagagctggggatattcggtgttctgatcgttttgggattatattttgcgttaatgcttctcggcgtaaaaacggccgtgcgggctgatgacccgttcgggaagcttcttgccatcggaattacgtttcaattaatgtttcaggttgtcttgaatttgggagcgatgagcggactcctcccggttacgggtgtgccgcttccgtttatcagctatggcggttcttcattgattatgacgctgtttttgtgcggcatactggtcaatatcagtacatatgcgaaaaaacaaaccgtacggcataagcgtcctgccccgcatgaaaaaaaggcttcttctttttaatgaagcccgaaaaaaacgcccgggacatgctgtctccgggcgttctgtctgtttataaagctcctggtccttcttctccggtgcggatattaatcgtgtttccgatttcatagacgaatattttgccgtcgccgggctctcccgttttcagcacttttttcgccgtttccaccacttgatcaacggggaccttgctgacaacgatttccactttcagccgttcatatacattgctttcaattttgactccgcggtacagttcggtgtgagctttttgaaggccgcagccgtgtacgttggagaaggtcagcgatgtgactccgattttaccgagttcctgtttcaatgtttcaaacttagccggacgcgtaacgatttctaccttgaacatttgaccgctcatctaagccactcctcactttataagtcctgatatgctttttccccgtgcatcgttaaatcaagcccaagtgactcttcttcttcgctggcgcggaggggaatgaacagacctacaattttaatgataacgaaagtgacaataaatacaaatacataggttgccgcaatggccgcaatctgcttccagagcagtcccggatcgccgtaaaacagtccgtttgccccgccgtcattgacggaagtggtggcgaataaaccggtcgcgatgccgccccatgtcccgccgattccatgcaggccgaaagcgtcaagcgcatcatcgtatccgaaagtctttttgagccaatacacgccccagaagcagacaagcccgccgatgaaaccgattacgatggaagagaacggcgtaacgaacccggcagccggcgtaatggcgacaagcccggcaatagcgcctgatacagcacccagcatggtcggttttttgttcagcatccattcgattaaaatccagccgataattccggccgcagccgcggtgtttgtgttaatgagggcaaacatcgcgatactgtcaagcgtgagggcgctgccgacattgaagccgaaccatccgaaccaaatgagcgccccgcccaagaacgtgtaaattaagttgtgaggcgaagccgccgtgccgtccttgcgtttcccgagcacaatcgccagcacgagcccggcgaccccggaagaaatgtggacgacgtttccgcctgcgaagtcaagagcgcccatttggccgatccagccgccgccccatacccagtgcgcaacgggcgtatatacgagggaagcccacaaaaaggaaaatacaagaaaagcactgaatctcatgcgttcagcaaatgctccggaaataatggccgtcgtcagtacggcaaacgtcatttggaacatcatgaataatgaatgcgggatcgtatcactataacttccgggttcaaagccgacccccttcagtccggcccattcaatcccgccaagccatgtattcccgggggcaaaagcaagtgaatatccgtacaaaacccaaacgacggatacgatggcgagggaagaaaaactgtgcatcgccgtgctgagcacgtttttgctttttaccattccgccgtaaaacaaagccagcccgggggtcatcagccacacgagtaaagcgcaaaagaacataaatactgtatcgcccatctgcatgttgtattcctccgtctcattcaaaatgtaatcgtgattaattcattattatagagaaaaaagaacgataaaacattttcgtgtaaggttatctgacatgtttttttgcgttcataatgtcgctttttcaaaggggtgtcatgcgactttatatccataaaaagagcgctggagcatggcggaagaaatcctgtccgggaaagagtaaaataaacggggtgagaaacactaactgcatcaggaggaattattatgacaacatcattgaatctgcaatttgaaaaaacggctttggtccttattgatttacaaaaaggcattgtgccgatggataaaagcggtaccgttgtgccgaacgcgaaaaaattaattgatgtgttccgggaaaaaggcggatttatcagctttgtgaacgtagattttcatgacggagcggatgcgctgaagccgctgacggatgaagaggcggcgggccattcggctccgccggcggattgggctgaatttgtgcctgaaatcggagtgaaagaaaacgattatacggtaacaaaacggcagtggggcgcgtttttcggcacggacctggaccttcagctcagaagacggggaatcgacacgattgtgttatgcgggattgcgacaaacatcggtgtggaaagcacggcgcgggaagcttttcagctcgggtatcagcaagttttcgtaactgacgcgatggcgacattcagcgatgaacagcacgaagcgacactcaaatttatcttcccgaaaatcggcagaagccggacgacggaagaatttatcgcacagacaaaatgacaatctccaaaaaaagccgcgtcctgttcttgacggccgtggcttcggggacgatgctgaacccattgaactcgtcgatgatttctcttgcgcttcacagtattcagcatgaatttcacctgtcgtttacaacggtgtcctggctgatatcgtccttttatcttgccagcgcggtggcgcagcctgttaccgggaagctcggtgatatgctcggcaggaagaagctgtttttgatcgggcttctgcttgttgccgtctcggcggtcggcgcgccgtttgcgccgacttttatgacattgctgatcatgcggctttttcaatcgatcggaagcagcgcgatatatccgtccggcgtcggattgatccgttcaaatatacaggagaagcaggcttcggcgctggccgtcctgtcaatctttgcatcagccatgacggcgctcggtccgactctcggcggttttctgatcgtttggggagggtggccggcgatctttttcgtcaatctgccgtttatcatcctcagtttttttctcggaatgtatatgtttccgaaagatgaaaaacgcgagatcggcggcttgaaaggcgtgctccgccagcttgatacaatcgggatactcctgtttgccggagcgattatccttctcctgtcgtttttattgtccttcagtacgaagcctcactatacagaaggcgtattcgggcttttatttgtcgggctgtttatctggcgtgagctgaaaacagagaagccgtttattgatgtcaggctgtttaaaacgcatcggaaactatcgtcggtgtatattcaatttattttgctgaatatattcttttactgcatctttttcgggcttccgagctattttcaggatgaaatgcatttgtccgttcagacaagcggattgattatgctgtttatgtcgggcatgagtattctggtgtcgcctttgaccggaaaatggatagataagaaagggcttcttcagccgattgttgccggaacctgcctgaccgcgatcggagcggtgctgttaacgtttttcttccttcaggcgcccatgataggaaaagggctgatcctgtccgtgctgggtgtcggctacggtttcggaaatgtcacgtttcaggcggccatgctgaaaacgagccccgccgacatggtcggaacaacgtccggcctgtttcagacctgcaggtatctcggttcgattttgtcttctgtcattttgggcattcttttcggaaaagaaattaccgccggccattttcatatgctcggcacgattcttatcgttgtcggcgccgtaagccttttgatggcgttccggttttcggttctcctcaaaaaagcctcttaacaggcgcaaaaaaaagagacgggctctccccgtctctttttttgtgtaatgtgctcaaaaatcaaaacgattattgtcgacagcgaccaatgttatttgcggaattttcagttatattttttcacatgtgatgtaaggaaaacgtacatgcaggagggagaaaatgacaaaaataacgagtgatcggctaagcaacaaagatttactgcctttagaagacggcgaacggacatggaaggcggtgaattttgcatccatctggatgggttgtattcataatatcccgacctacgcgactgtgggcgggctcattgcgatcggcctttctccgtggcaggtgctcgccattatcgtgacggcgtcactgattttgttcgccgctttggccttgaacggccatgccggaacgaaatacggcctgccttttccggtcattatcagggcttcttacggaatatacggagctaacattccggcgcttctcagggcatttacagccatcatgtggctcggaattcaaacatttgccgggagcactgccttacacattctgcttttgaacatatggccgggctgggggagtctcggcggagattggaatatattcgggcttcatctgccgggctttctgtcgttcattttcttttggggcattcatctgcttgtgctgcggcacggcatggaatcgatcaaaaaatttgaagtgtgggcgggcccgcttgtttatctcgtcttcggcggcatggtctggtgggcgatagatattgccggcgggctcggtccgatttactcacagccgggaaagttccatacattttctgaaacgttttggccgtttgccgccggagtgacgggcattatcggaatatgggcgacgctgattctgaatatccctgacttcacccggttcgccgcgtcgcaaaaagaacagattcgcggccagttttacgggctgccgggaacgtttgcgctgtttgcgtttgcaagcatcacggtgacatccggatcacaggtagcattcggagaaccgatctgggatgtggtggagattttggcccggtttgataatcctttcgttatcgctctttcggtcatcacactttgcatcgccgccgtctcggttaacgtggcggcaaacatcgtgtcaccggcctatgacttggcgaatgtcctgccgaagtatattacattcagaaggggagggtatttgaccgccgttttggctctgttcacaataccgtggaagctgatggagagcgccacgaatgtatatgcgtttctcggactcatcggcgggatgctcggaccggtggccggggtgatgatggctgattattttatcatcagaaaaaggcagctctcagttgaagacctttattcagaaaccggacagtacacttattacaaaggctataattaccgggcctttgccgcgacgtttctcggcgcgtttatttctttaatcgggatgtacgtcccggcgttcgccggcatctatgatatctcctggtttgcgggtgtcattttgtcatgtctcggttatacggcgcttatgtacattcatcctccttatgcaaaagcggagggacgaatcgtgcgggaaagagcggccgaataaaaaaagccgggggctgcccccggctttttgtcatatcagtctgcgattgaaacgtttccgtccgcttcaagcggcgttctttttttctggctccagccatacaggagcaaagcaatcaggacgaacagccccgctgccagataaatcgaatggaatccggccgaagcgacgaagaggccgaatacatatgacccgccggcaatcccgctgtcaaagaaagtgaagaaggtcgccgtcgcaaagcctgaacggtgtccgggcgaattctgaatcgccagcgtctgcatacacggtacgatagagccgtatccgagaccgattacggcaccggacaagagaagcatgagggcgctgtttgtcatcgccagcatgcaaagccccgcggagaacacgataatcgacggatagatgacgattcccggccccactctgtcaaacagctttcctgtgaaaggacgggcggccatcatcgtcacggcgaaacagacgaagaaatagccgctgacatccaacaggtggatcgtctttgcataaacggataaatatgaagtcacacttgaataacagaaagaaatggacaacccgacaatcgcgattttaagcgcgcctttttcaaacatgtcggagaaagaaaaacggaacacagtcgttccgctgttgttttgatccggcacacgaatcataaaagcaatcagcaagcctaaagaaacaaatacagcaaaaagcgtaaagaacaccgggaacgatatgactttcacaaggctcagtccgagaaacggaccgatcgccatggcaaggttcatagacatcgcaaaataaccgagcccctcgccgcgccgcttggcgggaataaggtcagcggcaattgcgcctgtgaccgtcgttaaaatgctgaaccagatgccttggaaaaaacgcagtccgagcagcagatagaaattgtgtatcggcaaatacagataagaagacagggcgaacagcgccagagatacaatcgtcattcttttcttaccgaaccgttcaataatcgcccctgaaaaaggacgggtgataatagcagataacaggaacaggctgatcaaaagccctccttgcgattcactgccgccaagctcctgaatcatatagataggcagcacggccaaaaatgtataaaagaacacaaagacaaataaatttacgagtacgaccataataaaatctttggtccagatcgagtcagatttactcaaaagtacagcacttccctttctttattatttcgttaaaaacacattcagaaactcagaaaaagcttccttatctccatcttggaaatccgcaagcatgtcttcctcgaacttcagcatctcttgattgatgctgttgtatttcaattcagcttccttcgtcaggacgacgagcttttcccgcttgtcttctccctgttcccgctgaatccagccgttttcttcaaggcgtttgatcgttctggtaacggtcggcgcctctacgttcagataagaccagatttctttttgggtcatcggtccgatcgtttttaagcaatataggattgaccattgagaggagtacaggccgaatggttccagccgttcattggctttcttcgtaatcaggcgggcgcattgattgatttgatgaatgaggcgtctgttgacgtggatcatttccgttctccttttcaaaaaacttacctaagtaactaattgtgctgtttcattctacagcaggatcgcgcggatgtaaaccccccgttcaaaaagcagaaaattatgacccgccccttgtccttattgagtttttagcatattcccaattcattgctaatacactgttacaaacctatcaaagagagtgtttgaggtgagggatcgtgggcatatttctaaaaccttcttatataatcggacaacgaagaagctgcatcatcagtgaatctgttacagaatacggatctcatttcacacttctcacatccaactggggaggtcgagtggtgtgcacgattacatcaaagagcgaacaatcaagattggtaagtatatcgtggagacgaaaaaaaccgttcgtgtcattgcgaaagagtttggtgtttccaaaagtaccgtacacaaagatctgacagaacgcctgcctgaaatcaatcctgacttggcgaatgaagtaaaagaaatactcgattatcataaatccatcagacatttaagggggggcgaggcgacgaaattaaagtacaagaaggatgaaattcttgaaggggagcccgttcagcagccgtagcgcctgacgtctgccgggcccttttttctcctccgggcggtttcgcgaatatccgcaaaattttgtcaagaacttatatcgatcagcagcttttttttgataaattatgataatatatataattagggcacaatgtggatattttactgtgaaacagatatcaaggaggatataaatagatgtttgcaagggatattggaattgacctcggtactgcaaatgtactgatccatgtaaaaggaaaaggaattgttctgaatgagccttccgttgtggcacttgataaaaacagcggcaaagtgctggctgtcggtgaagaagccagacgaatggttggacgtacacctgggaatattgttgcgatccgtccgctgaaagacggcgtaatcgcagacttcgaagtaactgaagctatgctgaaacatttcattaataagctgaatgtaaaaggacttttctcaaaaccgcgtatgctgatctgctgcccgacgaatattacatccgttgagcagaaagcgattaaagaagcagctgaaaaaagcggcggaaagcatgtgtaccttgaagaagaaccgaaagttgccgctatcggcgcgggtatggaaatcttccagccgagcggtaacatggttgttgacatcggaggcggtacgacagatatcgcagttatttctatgggcgatattgtcacctcctcttctattaagatggctggggacaagtttgacatggaaatcttaaattatatcaaacgcgagtataagctgctgatcggtgaacgtaccgctgaagatattaaggtgaaggtcgcaacggttttcccagacgcacgtcatgaagaaatcaccatccgcggccgtgacatggtttccggcctgccgagaacgattacagtaaacagcaaagaagtggaagaagcccttcgtgaatcagttgccgtcattgtgcaggccgccaagcaggttcttgaaagaacaccgcctgaattgtccgctgacatcatcgaccgcggcgttatcattaccggcgggggagcgctgttaaacgggcttgaccagcttcttgccgaagagctgagggtgcctgttcttgtcgctgagaacccgatggattgtgttgcggtcggaaccggcgtcatgctggataacatggacaagcttccgaaacgcaaactgagctgatgataaaacctcattctgaaaaagaatggggtttttttctgtcaaacccttcacgaacgggaatgtaaatccgataataagaaaaaatgctgattttcattatagaacaaatgttccggtgaggcaactggaaataatgctatttcagaggtggaagacttgttaaaaggattatataccgcaacgtccgcaatgattacacagcagagaagaacggaaatgctgtcaaataacatcgcaaacgcgaatacgtcaggatacaaagaggatcaaggttcaatccgcgcctttcccgagatgcttctgagccgaatagaaggcgataaaaaaacgaaaatcggttccgtcaacacaggcgtatacatgcaggagctgaaaccgttgtttacgcagggaagcctgaaaacgaccgatcagccgacggatatcgcgcttatggagaatcaggttcccaagaatgccgaaacgaatgaaaacgccgagctgttttatcccgtgcagactgcgggcggcgtccgctattcaaaaagcagcactttctcattaaatgaaaacaatcagcttaccataaacggaaaccttgttttatcaacaaacggacagccgattacagtcgacaatgaaaaattcaccgtatcagaaaacggaacggtcacgacaaacggccggccggcggggcagattgacatcaggatggaagaagacgtgcgcaatctgaaacgggacggcaatgacctatacagcacggccgacggcactgaactgccgagcgcggcggcgaatccccaggtctcgtattcattaaagcaaggcgtctcggagctttcgaatgtggacgtgacgagcacgtatacagaaatgacggaagcatacagatcatttgaagccaatcagaaagtcattcaggcttacgataaaagcatggataaagccgcaaatgaaatcggcaaagtgtaacaaaatgggggacgttcaattatgatgctcagatcaatgctgacggcttcaacagccttaaatcagcttcagcagcagatggatacagtcagcagcaacctttcaaacagtgatacgacaggctataaagcgagggactcccgcttttccgagctgatcagacagcagtatgaccatatagatgacaaaaaggaaaattcgccgaacatgcggaaaacgccgcccggcctgcgtctcggcgccggaacggtcatgactccgcagctggactcagggcagggaggcatcaaaaaaaccgaccgtgaccttgatatcgcgttcacctcaccttatcaatatcttcaggcagaagcggacggacggcgggtgtatacaagggacggctcactttccctcaagccggccggcggaaatgaccgggtgcttcagctgttgacagcgggaggcaatcccattctcgatgagaacggccagcccatacaaattgacagttcgctgaatcagctgaaaatcagcaaaaccggaacgctgactgcttcagacccggcaggaacccgttcgcagacgtttaatctcggcatcgtcaatgtcaataatcctcaggcccttcatgcggaaggggataatctgttttccgtaaacggagcgggggcatcagcgattgaagagcttaccggcgcaaaccggcaggcaatcggcatggagcagggcgcgcttgaaagttcaaatgtcgatatgtcaaaagaaatgaccgacctaatcgtgtctcagcgttcctatcagctgaacagccgcacgattacattgggagaccaaatgctgggcttaatcaactcagtcagataaaagaaggggcgttttgatcagccgcgcatgataaaaaatgcggctttctcaaaatcgcccttttttttgtagtaatcagtaatatcctgaagcagcacttccaaatccacccacgcttcaattttctgcagctccagcacgagtttctgcaatcggtcgtacgggtcctcctgagcggtgtacagtatgttgagcgcggtcagcttcaatttcattatcttgttctgcactttttcagatatgtataaacctttctgcagcacggtttgtccttcggcggcatatccggttttaaaaagtgctctgaccgcttcgtatacacaatgcaggtaggaaacgggagactctttctcgaaacgctgattgcccaatacctttttgtaaaaagggagggcctctttatcttttttctgggcggtctttaaaaaaccaaaattataataggcgtggcacagcaggttattgtcattgatccggtccgttatctttatggattcattaaagagctgttctgcgtcttcatagcgtgcctcgtctatgtaattcacggcgagaagcagacggcagctgagcgtttttttgatgtaaccgaattcaccttgatagatttccagcgctttattgacatattgaatggagagcgcaggcgacttcatcatgtaatatgcacccgctgttttataataaaattcagcggcttcgaaacggtcctgaatggccggcaggtactgttcagcttctttaaagcggcagacagcacggttcggagcgccattcaccatatggaataaccctttgaaaaaatagaaataataagttaattcatggtccatctcatctttgcgccgcttcagctcgcagaacaatttagtcagaccgtcttttttctcaaacagcagctgaaaccgtgcgaaaaacagctgatatctgagtttgagctttgcattcttttgtaatttggggagatgctgattgatttgttcgtgaagggaacgggctagatcgaattggcgttttcccatggcgtcataccactcattcagcatcaccagcgtacgtttttcagtaaacttagcaatcatcttccaacctctttgcatagggtaaaaatctttatttatcataacacattaatggacgaggctcattgccagctggttacagtttacagcgcggttgaaaaagaaattgattcataatatacttccaaatgtacagattggttagcgcatataccttctatacatactattgtcgatgaaggagatgtcaagaaaatgcttgatactcagcaaattaaagaaattattccccatcgctatccgtttcttctggtagacagaattacggaagtcgaagaaggaaaacgggcggcgggatataaaaatgtgacggcgaatgaagattttttcaacggccattttcctgaataccctgttatgccgggcgtcttaatcgtagaggctttggcgcaggtcggagcggttgcgatgctgattaaagaagaaaaccggggcagactcgcattttttgcggggattgataactgccgtttcaaaaagcaggtaaaaccgggtgacaagctggagcttgaggttgatattacccgcgcgcgcggtacgatcggacgcggcaaaggcgttgccaaagttgacggcgagctcgtgtgtgaagctgaattaacatttgcgctcggagaataaaaacaaacgaatgggcttataaaaaagcccattttgtatagaaaggggtgaatgtaatgtggtcagaatttaaaagctttgcgatgcggggcaatatcatggatctggcaatcggtgtcgtcatcggcggcgctttcggcaaaattgtgacgtcgctcgttgaagacatcatcatgccgcttgtcggcctgcttcttggcggtcttgacttttcagggctggccgtgacattcggcgatgctcatatcaagtacggaagcttcattcaaacgattgtgaacttcttcattatttcattttctatctttatcgtgatccgtacaataggcaagctgagacgtaaaaaagaagcagaagaagaggctgaagaagcagaagaaacagatcagcagacagaactgctgactgaaatcagagatctgctgaaacagcgggctcctcacaatgactaaggcacaaaaaaaggctggatgattaacgtccggccttttttatgattataatttttgtttaaacgcttcaatcagccggctgcccgagtagccttctttcacgagcgactccagaatgctttctgatccggggtggtttcttgacaccatttgaccgtaaattaaaacttgtatactcttttccagctccacaatatttttgatgcttcccgtcagctgggcggggcggttgctttttttcgtaatcgttacaaacaccttcgcttctttctggcttttcatcagcatgtcaaaaaaagaaaagtgttcggccgggaccagtgcttcaattaaccagtggttttctccgtcctctttgttgataatcaatccgtctaaaaggggaaactgttcaatcggctgatcgtctttatctaaacgttccacattcagatcaaccagtttaaaggttttcatctcttattttcacccctgttgtccatgtttttcgttcatttattataacacatatcatttttcccgggaaaatgctgtaagacatgcttcatcatttttgtaggcggtcaacatttaatcatttctattttttcattataatgtaaaagaatatggtcatggagagatgcttatgaatcaattgcgcctgaaggaaatctatatagaagacggttcaaggcgaaaagacgatcattcctacttggtatgcaaaaaggaagattgtgaggtgcatcttaacagaaggggaaatgtcgtctttttatatgaaacaaaagaccgcatggaacagtataaaattcagctttcattgactgataaaaagctgagtttttactggttcgcatgggacggcggaaagtttgtccgcatgtttgagaaagactggctcaaaacgaaacttttctcgcggctgctcaaaaatacatattacataagcggtcaaaaacaaaagttttttttatcagaaagaaaaacaaaaacataaaagcagcccaaacggataaaggctttttccgctttttgctttcataagcctttatactacaatgaagccagcctcgaaaaagagaggaggagacggcttgtttaaccacgttatgcttgtcggccggctgacgaaagacccggagctccgttttacatcagcgggcattcccgtcgctcatattacgttggcggtaaaccgcaattttaaaagcgcgtcgggtgaaaccggaaccgactttgtcaactgcaccatctggaggaaaaacgctgaaaacacggcattgtactgccaaaaagggtcaatggtcggtgtaagcggcagaatccagacgagaagctatgaaaagacagacggcgtaaaagtttatgtgaccgaggtcatggctgataccgttcggtttatggatcaaaaacggaaagagccgctggctgaatagcatgcttttttcctcgatttcccgcctttcagcgggccccgcaatacctccttcccattcgccagtcgaaagactggtttttttgtgcgggagctgaaaaatggttaaaaagaagtgatttcgcttataaatacttaaaaacattgaatatattgggataaaaacttataattacttacagataagtgacgaaaaaaagggaatgaggacgtgtatcaagaagaaagactgattgcgataatggaatatttgaaacagcaccggcggatcaccgctgaacagatatgttcgctgcttcatatttcaagagataccgcaagaagggaccttgtaaagctgaaagagcgaggggccattatcagaacacggggcggcgcgattctgccgtcagtgaatcaggaagttccgggctattcgggccggctgaaaaccgtttctgaagagaaaaacaaaatcggcaagctggccgcatccctgattcataaaggagaccggatcatcctggacacatcgacaaccgttcaggcctgcgcggagcatttaaatgtcaccggctgcactgttattacaaattcgatcaatcaggccgatatcctttccgcaaaagagggaattgatattcacctgctcggcggaaagctccagaaggaacaccggtttttatacggggcttccgttgtagaaaaactgggggattatcacgctgataaggtgctgatcggcgttgtcggcatctcggaaaacggcctgacgattccgcatgaagaagacggcatggtaaagcgtaaaatgatccgtcaggctgaacaggtgattgcgctgagcgatcactcgaagcttggccgtacgagtttttatcagtatgcagacctgcacgaggttgacctgctgattaccgatcggctgcctgatcaggatttttgcgatctgctcgaccggcacggcgtagaattgcttgtaactgaatctgaagaagaggatgaggacatgtgaaactgattgccatagatctggacggcacactgctgaacagcagtcatcaagtaagtgatgaaaacaagcgggctttaagggaagcccggcaagcgggaattgaaatcgtggtttccactggacgcgcgcattttgatgtgcactccatatttgaaccgctcggcataaaaacatggattatcagcgcaaacggagccgccatccacgctcctgacggcagcctgtaccattgtgaagcgattgaagaaacaagagcccgggggattttgtcatggcttgaagagaatcaatattattatgaggtgtttacaaacaaagccatctatacgcctgaaaccggcaggcagctgctcgatatcgaaatggaccgggtgaaaagcgccaatccggaaaccgatctttccgttttggaacaggcggcttcagtgcaatacagccagtccggctttgcttacattcattcataccgtgagctctttgagaaagaagagcatctggatttttataatattctcggattttcgtttgatgagcggaagctgaaagcgggctgggaccgattcagcggtcagaaagatctcacccttgtcagctctgccgatcacaactttgaagtggcgtctcgaaacgcctcaaaagggcaggcgctcaaacggctggcgcaaaagctcggcattccgatggctgaaaccgccgcggtcggtgacagcttaaatgactattcaatgcttcaggcggccggaaaaggcatagcgatggggaatgcgagagaagatattaaagagatcgctgatgccgttacattgacaaatgatcaaaacggcgttgcgtatatgatcaggaatttactgtgaaaggtatggcgatactgttcatgactggcgtgacgcattcatggcaaatgcggcgtaacagtaaggacgacataaaagaccggctcttccgagagagccggtctttttgcgtttaatgtgattgcgtcgatgcgctgagggtgaataattcttcaagctcatcggatgacagctcggtaatccaattttcactttggataatctgatcgttcaaagtttgtttcgtttcgagcatggcatcaattttttcttcaatcgttcccgtcgtaatgagtttgtgaacgtggacgaaccgttcctggccgattcggtaggcgcggtcggtcgcctggttttccaccgccggattccaccacctgtcatagtgaatgacatgattggcagccgtcagattcaggccggttccgcccgctttcagtgacaaaatcagcgtcgggtattctttcttctggaaccgttcgacgagggaatcgcgttcctgcttggacaggcttccgtttaaaaactgaaccggttctccgaatgttttttccaggaggcgcttcatcatgttgcccatctgaatgtattgtgtgaaaatgaggcagctttccccttgtccgcggatcgccgccattaagtcaagcagcttttccagtttgacggatctcccgtttaacagctctgtctgttcttccttcaaatagagcgcaggatggtcgcatatttgcttcaagcggccgagcatgctcagaatcagcgctttccgctgcatcccggtcagagaagccatatgttcaaatgtatctttgacaagctgttcataaagggatgcctgttcggctgagagcgggataaactctttttgttccagcttgtcaggaagattaagcgccacttcttcatcccgttttgtccggcgcagtaaaaacggccggattaactgctgaagctggttgattcttttttcgtcacggtctttttcaatcggcagcacatagcgtttatgaaagccggtcagactgccgagatagcctttgttcataaaatcaaagatcgaccaaagctctgtcaggcggttttccatcggtgttccgctcagcgcgatatgatggacgcctttcagctttctgattgcgcgggactgcttcgtatgcgcgtttttaatgttttgcgcttcatcaaggcagacggtgctccatgtcacggaagaaagctcttcctgatcggcgtgcgagaggccgtaagaagtaagaacgacatccgcgtcctgataggccgggacaaatgcttcccccttcggcctgcgggggccgtaatgaagcacggccttcagctgcggcgcgaaggtctggagctcacgctgccagttgccgagcaccgatgtcggcgcaatgattaaggcaggcgctttttgccggccgctttccttcacatggagaaaataagcgatcatctgaatcgtctttccaagtcccatgtcatctgcgagacaggcgccgaagccgttttcccgtaaaaacagaagccagttcatgccgtacatctgataagggcggagctggccctgaaacgcggcgctgacttcatgctccggcagatccccggcatccgtcagtttgcggatcaggcttctgagatgctttgataattcgatcttgatcccggcaaatgccgatgagtcaatgatgtccgtgtcctcggctccgttttccccgtgatccatcagttcgcgcgccagcacgtcggacatgtggaggccctcagattccgctttttccatcagtattttcatctgtttaataaattgcggatcaattttcacccattggccgcggatgttgacgagacgtctgttgtttgcgacaagctcattgaattcatcctctgtcagctcaatcccgttcgtggcgaatctccagttgaaatcaagcagagcgttcatgccgacgaaggactcgccccgcggggaggatgacactttcgccttaagcatcatattgctgtcccggacaatctgccaccatgatgggagaagaatctccacacccatatcgacaagcgtctcactcgcttccgataagaagatccaagcctcttcttcagatatcagcgtcgttcctgaatcaaacgaaagccagggaaccgttctgcggaagcggtcctgttcacgcgcgatttttccgctgtatgcctgccacgcttttttcagccctttcagtccgtcgaaaaaggtgatggagccggtttttttctcacgtaaaaacatctcgattttccagtcgtcaccgtcgaaatcaggctcgtttaatcggaggccgacggtaaacggcgtcagatcgtcatgccagccgattccctccagaaaatcctcttcatccaaaaaggagcctttaaacgtatgaacggccggcgaacgggtttcgatccgccgccatttttccagcaggtcatcattgtactgaatgtagtcctgtaccgcggctgagaaccagtctgccgtaaagccttccagcaaaagctcgcggtctttgaagcgcaggaggccattttgccatgcgtcataatccggaagaaaatcgccgtcggcaataaattcgtatatcgtcgaagccgcttcgattaacggttccgtttcctttgtcagctgcacggtgctgaatgaattgaacgagttttttccaagcagctcgacggtcatccaagggctgagcagaacggccggagtgccgatgaagctgacgtcttcaagaaacgttccgtaaaaggtggactcatgccattggaacaaatgagtcttcatctgactgagagtaagcggctgctccttctcatcatggcttgacagcgtaaatgtccaatcttccatttgttctacatgaatgaaaatttccttaagactcgccatcaatcaactttcctttctgcaattcttcttgaagggcgcgcagcctcttgtagcttgcgctcagccggctgatataacgctcccatacctgctgtttttttgcctttttataaagcgtccgcagttttttcagatggcgcgcagcctctttataggcgctgcggtttttttggtcgataaaaaaggccgccgcccggtgataggaggggatgagcgcttccggatcactggcggcaatttccttcaggatgtccttttcaatttcccagacggaaaaaccgacgaggctgtgaatctccacccattccgcgtaccgccgtttttcgtacaggtactggctgtattcggtaaaggtatagggaaggcagccggaagcaaaccgttcaaacagctgatcatcccgtgagtgccgcgcataatccgccaacagcgcaaacagctctccgatgatgtcgcgcatttctttaaacggcttatcaagcttcgtatagttcacggcaagcggttcgatccggccataccatgttttcagccgtttccagtcttttttcgcggtgagttcaccgagccattgaaaagtgtacggcagcgcttcaggagggaagcgggacatatcttcaaagaccgcttcatcatctttttgcaaaaaggccagatgaagccgtccgaaccgcacttccggcgaaaaacggcgcccgctttcctgttcgagaatctcttgttcacgcgcgacccatttcggccggttcaaaagcgcgctccacatttcaccgaatacccggaggcgttcgtattgaaaaagctcttctttcacaagcagtctgcggagcaccgggggcgtccggtctaaaaaaggatcgagtgaaaaagacaaggcgtacgttttcagtctgtcaatggaggaataaatcgtatccatcagctgttccacgtatggattaatgctgtaataatctttttcggcatccaatctgcctgactcaatcaaagtgaacatgtgaagccagacggcaagcgccgaatgaatctgatataagcttttaagctcgggttttttcggggcgtgttttttgagcgctgacagatagccgtaataaaggccctgcatcgtctggcttccggccggcgtccgcgcctcccacagcgagaattccgaatcaaaaaaagcgagccagcttgacagcgactcttcattcggcagcactttttcctgaaactgccggcggacaagctccctgctttcctcaagcttttctctttccagccaatgttcggtaaaggtaccgacccgctcgaattgggcatatacgtaaagaaaaacggcgagcacgtggcggcagatcgcctcagacgggcatgcgcagccgcttttcaccatgaaaaataagttcagcgtgacccttacaggcacaacatcctgcacatatgcggaaatctctgtcggggtttgaacctgtatacgatagacggaatcctgccgatataaaatgagtgctttcttcatcagctgaacattgtcttcattgtaaggaagaagttctttaagctgttcagccgctgcgagcacatcttctttagcaatcatatcctgaagcatgattatcgctcctaacgagtcacaaaataaaaagattccaattcctctattatatcgcaacacatggcccggaaaaagtttttcctaaaaaaggacataaaaacccgaatgtgtcgaatgatgtattagagattgcaaaacagcacccgacagcatataataatcttgttttcaatttaatggaagccgaaaggaaacgaatgatgaagaaaacgaagttagatcaagaggagtttctgaagattttaatgcatgcgcacgacatcggtgagcagtcctctgagatgaccacaaaagaaatgcttgagaatttgatttcttatattaaaaatggatatgcaacataaaatcccgcagcctcctggccgcgggattttttaatcttcctgtgacaccagtatttaaagcgcttacaaatataatacagattgaagtgattgtctatttttgtcgaattttgtcatttgaaaaggttagaaatgacagtttaaagctgtataatcgtaattggaaaagatcattggagggaatgggaatacacggaaagtgatatggaggttatatgggagaatctgcaagcataaaggaaatattcgcaatactgagaaagcgtctgctgtttatacttattattaccgcggcggcatcttccgcaggcggtctcatcagtttcttcgctcttacgccggtctatgaaaactcaactcaaattttggtcagccaatccaaaaacaatcaaaaagaagtccaattcaatgacgttcaaaccaacctccaattaatcaacacgtataatgtcatcatcaaaagcccggtcatcctcgatgaggtgattaaacagctgcatctgtccatgacttcgaaagagctggaatcgaaaatcacggtatccagcgagcaggattcacaagtcgtgacgattgccgttcgggatacggatgctaagcgggcggccgttatggcaaatgcggttgcatccgtttttcaggacaagatcaccgccatcatgaacgtggataatgtcagcatcctttcaaaggccgaagtgtcggacagccagtcaccggcagagcctaaccgtaagctgaacatcgcgattgcgtttgccgccggacttttgggcggaatcggtctcgcctttttgctggaacatctggataatacgatcaaatcggaagaacagctggaagcgctgctcggcatcccgatcctgggaacggttacttcaatcagtactaaagacagcgttgccaaaagcttgaggatggcggaaaccaaacaagcgggaggcggacatgttgacgcgtaaaaaagacaaacccggaaaacgaagcgtgattgcgatgtctgagccgaaatccatcaactcagaacaatatcgcacgattcgcacaaacattgaattttcttccgttgatacggaggtgaagtcccttttgatcacatccgccggtccggaagaaggaaaatcgacaaccgcggccaaccttgccgtcgtatttgcacagcaggggaaaaaagtgcttttaattgatgcggatctgcgcaaaccgacggttcatttcaccttcaaattggataacggaaccggattaacgtcgctgctgttaaaacagatgccgtttcagaatgccgtcctgccggctgatgaagcaaacttggatattttaacgagcgggccgagcccgcccaatccggcggagcttttatcgacgggtgcgatgaaagatcttctgtcagaagcagccgcagtttatgataaggtgattttggatacgcctcccgttttggccgtagccgatacgaaaatattaggcagctacactgacggggccattatggtgatctcaagcgggaaaacggacaaagaaaaagcggccaaggcgaaagaagcgctcgattactgcccgtgcaagctccttggggccgttatgaacgggaagaaacaaacgaaacattcggactacgcctattacggacaataatgtcacaatgggcgcggtccattctttttaaggagggattgaaatatgatagatatccattgtcacatccttccttccatagacgacggcgcggcggatgatacagaaagcctgaagatggcgagagaagcggtcagacaggggattgatacgatcatcgcgacgccgcatcatgtgaaataccgctatgacacggatcggcatacggtcaacgaagcggtcagcctgttaaacaaacgtttgaataaggaaggcattccgctgactgttctgccaggccaggagatcagaatagacggagatctgctggcaggtcttcaaagcggctcgcttgccccgctccataatacaaagtatgtgctggcggaatttccggcggatcatgtcccggcctatgctgaaaggctgttttatgaactgcagctgaacggatatgtccccgtcatcgcccatccggagcggaacagggaaattcgcgaaaatccttccgtcctttacagtcttgtgaagaaaggggcggccgcccaagtgacggccggctgcattgccggagcattcgggcggaaagcgaaatccttttcgctgcagctgatggaagcgaatttgatccactttctcgcatctgacgcccataatctcggaccgagaaatttttattatcaggaggcgatcagcgttctgaaaaaagaagcaggggcggagctgatttacatgctcacggaaaatgcggcgcttctcgctgaaaacaaagccgtttataaggaacctccgctgcctgtggcccgccgtaagcgctggggtcttttttaatcgtcgtctccatcccgtttaaatgaagcgtaagcggctgttttgcaagatgattcttttatgcttatgctattatcagcggccggcgccgttttttcctatcatgacctcaggctcccggcattccgccggtgccgggatcatatgataatagcggtaagctgcccagcagcaatttctaaacggttgggggaacacgatgaaaataacagtgatcggaacaggctacgtcggtcttgtgacaggagtgtctctttcagaaatcggccatgacgtaacatgcatagatattgacgaacgtaaggttgagcagatgagaaagggattgtcccctatctttgaaccgggccttgaagatatgatgaaacgaaatatcggccggcatcggctggcatttgaaacgagctacgaaaaagggcttgcggaagcggacgttatttttatagcggtcggaacgccgcaaaaagaagacgggcacgcaaaccttacttatattgaaaatgtcgccgaacagattgccgaacatatttctaaagatgcgatcgtcgtgacaaaaagcacggttcccgtaggaacgaatgacagaatcagcgaagttattcattcacggctgagagcggacgtgaacatttcaatcgcttcgaatccggaatttctccgtgaaggttcggcgattcacgatacctttcacggcgaccgcatcgtgatcggggctgaagaccggcagacgcgggaaacgcttgaccgggttttcgcgccgcttgcgattccggtatatcatacggacatcagaagcgctgagatgatcaaatatgcgtcaaacgcatttttagcggcaaaaatcagttttattaatgaaatttctcatatatgtgaaaaagtcggtgcggatgtggaatcagtcgcacacggaatgggattggataaacggatcggcaatcaattcttaagagccggcatcggttacggcggttcctgttttccgaaggatacaaacgccctcgtgcagatcgcgggacatgtggagcatgattttgaattgctgaagtccgtcattaaagtcaacaataaccagcagtccatgctggttgataaagtgctgaacaggctgggcggtgtgacggggaaaaccatcgcgttattagggctgtcttttaagccgaatacagatgatatgcgggatgccccgtccattgtcattgcggatcgtctggcggctcttgacgcccggatgacagcgtacgatccgatcgcgtcattccgggcttccgggctgcttccgtctgcggtttcctatcgggagtccatagaagaagccgtcaggggagcggatgccgtcctgattctgacagattgggaacaaattaaacacttcccgcttgaagcgtacaaagagctgatggaaaccccggttattttcgacgggagaaactgccactcgcttgaggaagcggaacaggcgggcgtggaatatatctcaatcggaagaagagccgtcgtgcctcagactgattctgtcacttgaaaggccggcggtccgcgccggccttttatcatacaatcattagagacgaaggagatattaatcgtggaaaacacatggaaattgccgaagcaaatggaatcatcccgcggtctgctggaaacgtcagcacggccctttatcaaactgcacgtcaaaaaagctgaaacgggactgtatgacaataaaattgccggagacccctattttccgaaacatgaaccataccctgaagatgaaagcggcaggccgatgaagcttctcgcccaaatcaattttgcggatatgcccggactacctgattttccggacaccggcattcttcagttttacatatcggtcagtgatgacgtatacggtttgaattttgacgacgggtgcgcgcaaacgggtttctgcgtcaaatattttgagcacgtgacagatcgggaagaggagctcatggatgatttttctttcgttcaggttgaagaggagtacgattttccgattcaatccgaagcgctgatcacccctgagctgtctgctgaatgggcgctcccgtctgattttcaattcaggcaatatgccgggatggatgccttcgactatttcgagcagtttgacgatgaggtgtatgacgaatatacggtgaacgcattcggccataaaatcggcggctatgcgtccttcacccaggaagatccgcggtcttattcccatcaaaaccatacgattctgctcttgcaaattgattcagatgatgacattgattcgatgtggggagatgtgggaatcgccaatttctttatcagaccggaagatttgaagaaaaaagatttctcaaacgttttgtacaactgggactgcagttaacgacattattagaatcatgatacaaggcaaaggagacggttattcactgtctcttttttttagggaatttatcatggatacatagaggagatcaatgaatggatatgccgtttgtgtgagtcttttggcgttaatgatgagcatctcggctgctgaaaataagtcatttaacctatttaagctgctttctgtctattttaaaatataatatatggaaatatagtatggaaaagtctgtgctttttgtacgactttttgcgtaagacgaggtgaaaacagatgagccattcaagcacattaagccatattaacagcaccatcagccataaactgggcgagatcgaacaccaaattgataaattaaaagaagcgaaaagagagatagaatctctgcaggaagagggcgtgtctgaaatcagggacatcctcaggccgcacctggatcatcattggaccggcacttttgctgaagaatttgatgaccggcgcgatcaggcccatacagaagcatacagaatcgtcacagacaaatacgacggttatatttacagaatcggcttaaagatgacacagcttgaaattgaaaaaggagggctccttgccgccagaagcatcgcgagagaggcagagcacctgctgacgctgggagaagaagcccttgacacggtcggagaaaaaatacaatcaatcaaaaaaagctggagttggttttaatggcagaaataaaactcaaatacggagccgtcatgaagcagcttgaatccgtcagcagcgctttggaggccgtttctatcgggaacgccggtacaaacggaaaaaacaagctcgactatacctccaaataccaatcccgcgaggcaaagcttgtatcgatgatcagcgaatacaagcaggccgttcataagaacatagcggacgttaaagacaacgtagattctttgaaggaacaggacgaggcgatcgctgtaaaataacgaaagaaaggacttgccgatgagcaaagtgtttgaatcacaatcgttaacggacgaagcagataagagaaagaaacaatacgaagcccttgaagaacagctgcgtgcgctcaaacaagcctttcaaggcgtggccgatctgggtgatgctttgaaagggaaaggcgcagacaatataaaggatttctttcagggacaagcggaaatcgccgacagctggctgacgcttgtctctgctcaaattgcgtttttaaatggcatttcaggtgacattaaagatcaagagctcagtgattcatatgcggagacttcatttttagagcatgagctgcccaatgcggatttgagagcttcagagattgtctccgctcataaagcagaaatcgattcgattttgtctggcatcagtgatattattcatctcgatacatatacgctggatgattacgcagataaaatgggtgatgcccagaaaaccagacgcgacacgatcacggcagtcgatacgcttgatgaatccctgaccgctgaatatcaaaacttagaatctctggacaacgcagtgctcagcaaatattcccttctcatgcaggccaccagcaacgggaaaagcgcctcccctatgtactatgacaaaaaagccttccacagcaatgaaatctacaaaagcgtcatggcgacagaaaaacagggcacggactatattgacgcaaaagcccagcaggccgaagcaagacggcttcaggaaaaggctgaagaagaagccaataaaccatggtacgaaaaaacatgggacggcatctgcaactttaccggcgaagtcaccggctattatgattataaaagagcagccgaaggtgttgatccggtgaccggcgaaaaactctccaccgcagaacgcgtcacagcaggagcgatggccgccgccggattcataccggtcgtcggctgggcgggccgcgctttcaaaggcggaaaagccatttacaaaaccggaaaaaccgtcattgccgcagaacatgctttagatgcctataaaaccggaaaatccttagacattctcaaaatgacagaaatgggcgcatacggcctcgtcgcctcaaacggattcacagaagccgtcacaggacgggatatgttcggaaacaaagtgtctgaggaaaaacggaagcaaggggcgctggaagctgcgctgagtttggttggagccggtgcattggcgaagcatgtaaacaaaggcataccgcttgcaacccattcaaaagttcaaaaagctaacaagacactagaaaaagttaaacaattcaaagtcccgacaaacgtccgcgtgtacgcagaacgcccagtaacagcgaacggctttacgtacggattcccaacagtccgtgtcgatgtggaaaagacggctgttaaagaacttgggattgtgaagatggcgagtagccagtcaaaaaaaccaaaatggttggaaaaacctgaggggatgactcaaaatgattatgttgctcataatggtactaactacagtaaaaagaaacggactgaagaatacaatgctgcgctagctgataaagagaagatagttggagacaattcaaatggatatcgtttaaaagaaccaactaactggatggaagaaagaggtatgatacaaataaaagaaagattaaaaagaaaatcttggtcagatagagatgggtttaattggcaatgggattcccagcatggtaaattagaaaagtggaaccgcagaagaacagagcatttaggagagtttgatcctgtaactggtaagcagacgaaaaaaggcgagccttcaagaagatgggatggttaaaactatggaacatggaatcagatttattaatgaataccctgaaatcggtgaattgcttcatcgtctatttgtgaatagggaattagacgaatggtacaagagcaaatgcgcagagaaaataaaagtacctgatgaatttaatcaaataaaaggtttgaaaaaaattgaagttagagatttaaacaatccttcaggagaaattgatatccatttgcaagatctttctggggaaaatggttttcatttagaacagcaaatcaatatgaaagtatctaaattggttcctgtttatgtattagattatagttattccctaagacacgatttaatagatggcgcttatgacattgtaggaaccgctgaatctttagaattcattcagggaacgaactatattaataaaataatgcaagagaaagggtttatcgaactcagttatttgtatgattactacgatactgtgtatgagtggagtgaattgccacatatacagcctttcaacaggagattaacattaggagatgccttgtttactgatgtattagaattgctatagttaagagcttgccttgttgttatcggcaagtttttttataataatttaacaatgtggagtacaaggagaagcagttatggatagagaccatatttctcaattgctgccattaaaaatctgtaatggctggtctgtagtactgaacaatttaagttcagaaaaaagaatgcaagaaaaatatgaattactaaaactacaaaatgaaaaacgtaatgctgttattaaggtaatatttgaaaatgattaataccatgtcatagtagcgggcttaaaaacagataagatttataaagaagactcttttaatgaaatagaacaattattggaagagttggaatatcaaatctggactgtgggaagtggggttttagagggtttgcagcacctaagccaacatgttcccaatttcttaaggcttaagataccagcggggtggactgttgattatattccattaaaagatactgaccctaaaactctagaggaaaatgatgatgcttggttatttgactttaatcaagatctcctgcagtttctcataaaactaaaaatttgctgcttgtagggtggtacccagaaggggatccaaccggcagttatggcattgaactgataaaaaacaaagattgggaaaatcctttagaagatattatgtgtactgaacttaaagaattacttaaacaattggatcttatttttatgaaagaaatgaaaaatgaattttaataaaaagcagattatactatctgcttttttcaatgaagcatatggagtcttcgctagatcgaaacacaggacgattgagcgcgaagactattttaagagaggaaaacaagtgaaatgaaaatacatcaaattcacgattttgaacaaaaagatgaatcggattttattcgaactcaacaatctcttatacataaaatcaacctatcccccgtcatccatccagactccgtcaacaccagcgcaggcgtcgacctcgcttattgggagcaggacggggaaccgtacggggtgtgcagtatcatcgtgattgacgctgatacaacagaagtgattgaaaaagtgcacagcatggggaaaatcagcgtgccgtatgtgtccggttttcttgcgtttcgcgagctgccgctgatcatcgaagcggccaaaaagctggagacggagccggatgtgtttttgtttgatggcaacgggtatctgcattacaatcatatgggcgttgccacccatgcggctttttttctggggaagccgacgattgggattgcgaaaacctatctcaaaatcaaaggctgcgattttgagatgcctgaaaatgaagtaggcgcctacaccgatattctcattgacggcgaggtatatggctgggcgcttcggacacggcgggacgtgaagcctatcttcttgtcttgcggacataacattgatttagaaagcagctatcagatcacaatgaaaatgatcaatcgagaaagcaggctgccgatccctgtccgtctggctgaccttgaaacgcatgttttgcgaacgttttatcggaaaaatcacatgaaacacttggagctctaagccaccaagtgttttttttgtatgcctggtgtctgctttaaaaaaccttgtcgtccttgcagcaggtttttatttgaatgtttttcgcgtcaaatcgataaatgcctttaatggcgcagacatccacttgtccttatgccatgctagttgagtaaaaacggggcattcattctgccagttgagttctttcatccgtccttcggcaatatcgtcttttactgtcatttcaggcaatagtccgattccgagtccggccatcacgcattgtttgatggcttctatgctgacgaattctaatttattagggtagactccggcgtcatgtaaagtgttctcaaagagcgtgcgatatgaacagccgtcctctgtcagcagaagggtttcattttgaagatccttcaatgctgctggtgagtctgctggaaaaggatggtcattggcggctaccattttgatttcatcctgaatcagagattcaacgtgcagtgcgtcttccgaccgattcacatccaaaatgaaagtgatatcaagctggccctgcaagagctgttctttcgcttgttcgttggaaatatacggtttgaatataagctttacttgaggaaaagcctgtttgaattcttttatgataggcggaaggcggtatgtgcactggctttccgtcgcgccgattttcaaggttccggttgtttctcttgcttgatttgcggccatttttgcttcttctgttaacgcaatgatcttctccgcataggatttgaacgttttgccggcttctgtcaggaaaagccgcttgccgagccgttcaaataaaggagtcccgatttcttcttccagtgatttgatctgagaggtaacgcttgattgtgcatagttaagcatcttggcggttagggtgaagtttacgtgttctgctgcggtaataaaggtgatcagctgcttcaattccatttgatctcgccctttctaaatcggttttatcgattggaataatcgaaataatcatctgtattgattgatgaatccattatatgatgaagaaaatcattcgtaaacaaaggagcagatgcatcatgaacattgcggttattcatggcggaacgaggcctggcggaaatacggatattcttgcggagaaggctgttcaaggattcgatgcggagcacattcatttgcggaaatatcggatccggccaattgaagatctgcgtcacgcccaaggcggctttcgtcctgttcaagatgactacgattctatcattgagctgatattaccgtgtgatattcttgtattcgccaccccaatttattggtttggcatgtcagggacattaaagctgtttattgatcgctggtcacagacgctgagagatccgaggtttcctgattttaaacagcaaatgtcagcgaagcaggcatatgtaacagcagtgggcggagacaaccctaaactaaaagggctgccgctgattcagcaatttgaacatatttttcattttatggggatgtcctttaaaggctatgtgctgggagaaggcaatcgtccgggtgatattcttcatgatcaacaggcgctgtccgctgcgagccgtttattgaaaagaagtgatgcgatatgaagctgctgctggttatctctggtatgttgattcttgcactctttctagcttggaaagcgccgacttctgtttggatacaggctgaaaccaattcacctcaggttcagcaatctgtgagaatggcaggcgcaacgctgcaagtcaagcaaatcatcaagagtgatgcaggcgaagaaacagttgtcatatcaaatggtatttccgggccaaaataaaaaagcacctgtccaggtgcttttctttataaatgaggaatcacaagccctccatacaaaaacgccgcgataatcagaaaggccggatgcatcttgaattttgtcaagacaaggagggaaatccccgcaatcactatcgcttgaacccagccgatcgctttgatgccgtctgcgccgatttgccaggtaagaatgagcatcatgacggcgatgacaggctggacggacagcgtcatacctttgatgacgggggattggcggaagcgctgaatgacgcgcaagaggatgatcaatgcgagcgccgacggtacgacggtggcgatcagcgcaatcaggaatccgggccatccgcctgcgctgtagccgacatacgccgcgattttggttgcgatcgggcccggcaatgcgttcgcaagtgcgagcatatttgagaattgatcgtttgagagccagctgtatctgttgacgacttcttcaaacatcagcggaatcgacgccggtccgcctccatatccgagtacgtttgcgacaagaaacgccataaatacataaatcaagatcatgaggccggcattcctttatcttttgaacgtttctttgtgattttgtcctttaatttaaaatgaaacgcgccgtatgccaagaaaatgataatgacaaagccgggattgatctgtaacgtttgcaggccgataaaagcgatgataaaaaacaggatgcccgtgacccagccgaaacctttaagcgctttttggccaaactcgtacgccatgatgccgagcatgacggcgatcaccggtgttacggcgccaatcatgccggcaacgattgctgagcggcttaagacattgacagccgcaaacaagcccgccatagcgagacatgtaggcagaatatgtgcgagggttgccgcgattgcgcctaacgtgcctttcagcttgaagcccagatacgcagccatttttgtggcaatcggtccgggaagcgcattagcgatcgctaatatttctccgaattcatcatcatctatccatttgtatttattgacggcttcatggcggatgagcgggatcaccgacgggccgcctccgaatccgagaatgcccgttcggaccatcgccgccgtaatgtcccaatagggatgtttcatggctatgtcctccttacagcttcatgcccgttctgcttttataccgtttaatcagcatttggcagtcgacgctgacgacgcctttttgcgtatagagccgttttgtcaaaaactcttccatctcctgatcatttgcgaaaatgccgtgcatatgcagcttgctcggtccggtcatatgataaaggcttgtcaccgccggctccttttcaagctttaatgcggtttcctccaaatactgcggctccacctccacgttaaaaaacacggacacatgacggccgattttcgccgggttgatgacagcggtgaatttttcaatcacaccggcatccagtaaatgctgaatgcggtgctgaaccgccactcgcgacaggttaacccgctttcctaagtctgtataggaaatcctcccttcctcgtgcaaaatcgagagaatctgtttatccgtttcatcaaggacaagattcggaatgctgtactcatgttccaaccggcttcaccttccttcatttggtggatattattgtatcatgaaatgttacggtatgaaggggaaatttttttattgttttcgttacgtaataacttaggattatttcttatcggaaagtaaatagtgtgtgagcttttctttcaggaaggtggataccggtgaagccgctttttatacttaggaaaatttgtaaaggggcttgccatgaatacttcaaccatcggaacgaaacaaatggtcgtcagtccgcattatcttgcttctcaggcgggggccggcattctggaaaagggaggaaacgcgtttgacgcggcagtggcggtcagcgcctgcctggcagtcgtgtatccgcatatgacgggtcttggcggggattcattttggctcacttaccataaagaaacgggacgaatcaaagcttataacgggagcggccgttcagggaagcatgtgacgagagacttgtatcggggcagagaagcgatccctctgcgcgggccagaaagcgccattaccgttccgggaatggcggacagctgggatgccgtgctttcggcgtacgggcgtctttcgctcgctgaggtgctgaagcctgctcttgattatgcggcaaacggattcccggtgtccgccgaccagtgcgcccacacagaacgcaatctcgctcttttagcctcgatgccttacacctcggccatttttacgagaaacaaaaaagcgcccatgcccggtgaacggtttgtccagaagaatctggcggccagcttggaacagcttgccgagaaaggcagaagcgctttttatgaaggagatctcgctcaaagcatcacatcctttctgcaaaacaacggcagccgtctgacacttgatgactttaaagcccaccgcggcgagtggacgaacccggtatcctctgattaccgcggataccgcatctatcaggctccgccgaattcacagggctttacaggcttaatgacgctcaatatattggaaaactatgatttttctcagattgaacacggctcctttgactattatcatctgctgatcgaggcgctgaagaagagttttcagcaccggaatgaagtgctgactgatccggcattttctcatattccgctggatcggctgcttgataaacggtatgcaaagcagctggcggaagaaatcggtgacacggctgcgccggcgctaagccgtccggtcggaagcgacactgcttatgccgccgtcagagatgcggaaggaaatgccgtttcctttatacagagcctttattttgaattcgggtcagccgttacggcgggggagacgggcattctgctgcaaaaccgcgggtcatttttttcgctggatgaatcccatgtcaatacacttgaacccggcaagcggacgttccacaccctcatgccggcgatggcctgtaaagaaggaaagccgcacatcctgtacggaacccagggaggagaaggccagccgcaaactcagacagcgatgattacgcgcatcattgattacaaaatggacccgcagcaggcgatcaatgagccgcgctgggtctgggggcggacatggggagaggagtatgaagggctgagggttgaaagcagaatcagccctgaaacgagagaagccttaaggcagagcggccaccgcgtcgagaccgttggtgattttgacgggcttatgggccatgcggcagcgatcgtcattgatgaagaaggctttctccaaggcggggccgacccgcgcggcgacggagcggccgcaggagtatagagcatgatacgctaactgatgaaaaaaataagcacgccaagagcggcagaaagacctgcgtaaaacgaatcgtacacatattgcttttcctcccgccggtgccgccattccattaagccgctgcagcaaaatagcatgaaaacaactcccgcaaatacgtacatttcattgaacaaagtcaccgctgcgatgcccgtaataagcagtgtgatttcgattaatcgatgtgtgccgtttatcggcttctgctttttaacagcctttggaaaatgaagaactttgacggcaaatacttgaaacataaggctgagcaaaataaatacggctgaaaaaatcagtaactgaatgaaatccatcgtctcctcctaaaaatgtcactcgtttcatatgggtgagggccttgtaagtttcagcattctataagacattaggctgagtttaatggtaaaagactcaaaaaagacccctttcgaaaggggtctttttgactagtttcttctattataatggttcctgcttcaggtcgggcggacaagcgtatatgtcttcccgagtctgacgtattcattccccgcgagccttgccgcaggcttcagctcatctgtccgtatgtagcctttatcggcgtcatatacttggtcattcaaatgaaaacaaacgactctgccgatgatgaggtctgtcgtcgtttctccgctgtcattttgaaacggaagatggcgttcgagtatacattcaaacctgacttttgcttcttttataccgggaacgctgatgcaggcgctgtctgtcacagaaaggtctgtcatgccaagttcactgacatcaggatcaagccttgccgccgttttgttaatgtcttcaataatggactcatcactgacgtgcaccacgaattcccgatgagcgattgcgtttctcgcggtgtctttctgccgtccgtccgcgcggctgacagagatggccagaagcggcggttctgcggagacaacgttatagaaactgaagggcgccgcgtttacggcgccgttgatggatgaccgcgtcgtgacaaatgcgatcggccggggaacgactgtgcccgaaagcaatttgtaggtgtcttttgcgttcagttcgtctgctcgtaagatatgcatgatttcggccgcctttctttatcgtatgacctgattatacagaaagaaaattcggaaacacaacaaaagaaaaccggctgcatatcttatcacgtggcatatatctgattgaggaaaaaggcttccgtttagccggcagcctatttacaaatggcgttacttgtagtttttctttacaacccagatgttcccgtctttccagtactctgttttgctgcagtaatcgtcttttttgcaagggtcttttttatgaggacggtaaggttttttctgcgtgcgttttttcttgcggcggcatgattttttgtggctgcgagattttttgtgagaacgggattttttatgactgcgagattttttgtgagagcggcgcgattttttatggctgcgagattttttgtgagaacgggattttttatgactgcgagattttttgtgagaacgggattttttatggctgcgagattttttgtgagagcggcacgattttttatggctgcgagattttttgtgagagcggcacgattttttatgactgcgagattttttgtgagaacgggattttttatggctgcgagattttctcttcttactgctttttggttcttggtacaaataatcttccaatccctcggtgcttgcggactttactgcttcttcgatatcagaatgggaatagtggcccattttgaaacctcctcatgatatatgttttaaggatgcgatccttactaccacatagtacgcatgaatgaaaaaagtgtatgtgtgattcgctgagttttatataaatagcacagcctaaattaatacagggagggttactgatgaaagaccaatcaacattgcctctataccagctgtttattcacccgaaagacttaatggagctgaaaaaagacatttgggatgatgatccggtgcccgcggtgctgagagtgaatcaaaaacggcttgacattgatctggcgtaccgcggctctcatataagagattttaagaaaaaatcgtatcacatcgctttttattcgccgaaaacatttcgcagggcgaaagagatacatttaaacgctgaatacaaagatccgtcgatgatgcggaataagctgtctctcgatttcttcgcggagcttgggacgctgtcaccaaaggcgaatttcgtaaccctgcaaatcaatggcagacatgagggggtgtatcttgagctggagtcagtggatgaatattttctggcgaaacggaatttggcggacggggctgttttttacgcggttgatgacgacgccaatttctcccttgtcagtgatctggagcgggatacgaaaacatcgctcgaacttggttatgaaaagaaaacgggaacgaaagaagacgatttatacttgcaggacatgatctataaaattaataccgttccgaagtcagagttcaagggggagatcgtcaaacacttggacgccgataagtatttgcggtggcttgcgggcatcgtgtttacctcaaactacgatggatttgttcataattacgctttgtaccggaatcatgaaacgggactttttgaagtcattccgtgggattacgatgcgacgtggggaagagacattcacggtgatcggatggaggccgattatgtcagaatacaagggtttaataccttgactgcaaggcttctggatgaaccgtatttccgcaaagcgtacaaacagcttttggaagaaacgcttcagacccggtttaccattgaacatatgaagccgaaggtcatgtcactgtatgagcagatcaggccgcatgtcgcaaaggatccttataagaaagaggagattgattgctttgaccgggagcctgatgtgatttgcgaatacattaaggagcggtccgccttcatcagcagtgagttagagcggtggaatatctgatttggaaatgaagaaagattttttacaaataggctggtgaatcagttcccgaaaataatcgtgatacgtatatatgcattatgctttttacattatgagaaaaatgactaggaggacaatagatgaaacgcaatacgaagcggcatcggtctgatgacaactttttgcatgcgatggaaggaaaagtaattactgtctaccggggaggcccggagtccaagacagggagattagcagacattcaatcggattatatcgctcttcaagttgataataaaatcgtttattatcaatggaaacacgtgaaaagtgtgacggaaaatacgagtgaaaccgtatcgccggccgaagcggcagaatgtgaaaaagctgatgattttcaagatctgatcagccggatgaccaatcgcacggtgcaattgaatcagggaggtccggaatcgaaaagaggaaagcttcacgaaacaggggatgattttctcgtgctggaaacagaagatgacggaatcgtatattttaacgccgatcatgtcaaaagcatcagcgcggaacaagaagaggacggccaggaggaggagcgcccggaatttgaaatggctgatgattttcacggcatatttaaacgcctgatccacaaatgggtatccatcaaccgcggaggtcctgaagccgttgaaggtatacttgtggataattccgacggccactacactcttgtgaaagataaagaagtgctgcggatctatccttttcatatcaagagcatcagcgaaggggcaaaaggagcagccaaaaaagaggagaataaagacgacgagaataaaggcgggaaagagagcgccgaagaagaaaagtcacatgaagaagaatctcgcgaagagcagcgtacttcctctaaaaagtcgaaaagatcgtcaagatccgttcgatcctcaaaacgggaggaagagaactcttatagctacgccactgtattaaggacaatagattataggtggaaacacggccgtaaatgattggaaagattgtccgtaaacgcgggagaggggggaatgaaatggctggattaagcagatttcttgataaacaagtcgatattgagatatcggggaatacgacattttcaggaactcttttggatatcggtcaggatatcattgtgattcatgacggccggacgtttctttatattccgctgctgcatcttcagaggatgacattgacgctcccggacgaagagaataaagaaccgtacgcaagaaaaaaaagtccgcatcccgaaaaacaggaacattccttttcttaccggaataccctccagcatataaaaggcagatttacagaaattttcgttacgggagaccgttccattcatgggtatgtgacaagtgttttaaatgattattttgttttcttctctccggtttataagactcttttcatctcgatgcatcatttgaaatggctgacaccctattccgatgagcagacgccgtatacattaaacagttcagagctgccggttgttcccgctaatgtgccccttgtccggaattttgaggagcaattaaaaagatatgtcgggaagctgattattctggatttaggagatataccgaataaagtggggctgttacaggacgtctcagataatattcttgaattgaccaatgcagacggggatactgtcttttggaaattgaatcatttaaaaaccatgcacctgccataaatgataaaactgcctctcttatacagcaggcagttttttttcatagctaaaggtaaatccagctgatccaaacatataaaacggtaatggtaaacacgacggtgagagggacaacgacaatggtcgttttgatatattctgaccaagaaactttttcgccgtgctgtctgatgatatgcatccagatcagtgtggctaatgtcccgatcggcagaagcaatgatccgatatcactgccgataatattagccagataaatgatttttacggttaatgggtcgatggacatttcagttaatgtcaaagtgctgatcattaaggcgggatggttattgaacaaattagagaggacggatgtagcaatgcccataatagatgcagcgtgggcaatgctttgtgagacataaggctcaatagactgaacaagcaatgccgtcagtccgatattatgcagtccgtaaatgataatgtacatcgtgaaggcaaaaataaagatatgccaaggcgctttccttaataagtccgccggtccgatttttaaataaaaccatctccagcaaagcaggatgactgaactgatgacagccacgagcgaaacggatatgccgttgtaagaagctgcaaacagactgatccggacaaacaatacaaataccaaaacacaaaacatgatgttcgtacggctgtttttttgggacaagtctggcggaggctgaagcggatgatatcgtttgtgttccagcgattcaaaatgaaccggaatatcggggagctgtttcggcaaacggcggtagaaaacggcaaacagcagaaaggccataaacaccagtcccagcgtgccggggataaacatcatattggtgtacaaataaaggtccatgcctatcattttgagagaaattaaattgacgatattactgacgccgatcggggtgcttgccgccgtcgcaattaatacgccgcttattaaatacggtgttttctgatgtcttttaagtccgagatattgtaagaccaatagtaaaataggagtggtgattaagacgctgccgtcattattcagaaagagcgtcattgaaaaacagagcaggttggtcagccaaaaaagccggatgcctgatcccttggcgcggtgaagcagtttggccgccgcccagttaaaaaaaccgaagctttccagcgcgatcgccattatcattgtggagataatggttattgatgctccggtgacttttgaccctatatcccccaaatcatgaaaggaaacggttccgcataacaaaacgagaatggcgcccagcgacgccggaacggcttcatttaatcccccgggtctccaaaatataaaaataatggtcacaaagaaagaaatcagggtcaaaatgacggtaatatgtgtaatgtgttctgcctccttttcgatgggtcattgccgccccgttatttttatccctcctgatcagttgtactgtatgtatacgggtacaggtcgtaaggtgtactgagcgtttctaccaatttagtaaaaatccataaaagcacaaaaaaaagaggctgctttcggcggccctcttttttatgcattttccttatccgcctgcaataaagcctggcgcttattcataatatccagaaaatgtttcaggatcggattttgattatccttgcggtaggcaatgacccattcggcagtgagctgcgcctgattaatgccgcggtaggcgacttcgagattaaacagctttttagcagaagaaggcacgaaggttacaccgataccggcactaaccaatccgatcaccatttgatactccgtcgcttcctgaacgattttcggtttgaagcccgcctgctcgcagtagtttacaaactccaggtataaagtcggccatgtttctttcgacagtgtgataatcggttcattttttaaatcctgaatgtcgattgtctgtttagcggtaagcgggtgctgcttcggcaaagccagaatgcacgggctgctctgcaccttttccatatgtaacgcggaatgttgtaaaggcggatgaaggatgccgatatcaatgttccccttcagaagttcttcctgctgtctgaaagaagaaatttcacgcagatcaagcttgacggaggggaatttttcgcggaattcccgaatgatcggcggcagaaattcatatgtggccgagccgacaaaaccgacgacaaggcggccgagctctccccgcgccgttctctgcgccatttcaatcgctttgtctatttcttcgatcgcgtttctgctgtgttttaaaaaactttctccggcagctgaaagctctacaacccgtttcgtgcgctttaataaggtcacgccgacttccttctcaagctgtttgatctgctggctgagaggcggctgtgtcatatttaaccgaagcgcagctttgccgaaatgaagttcttcggcaacggcaataaagtattgaagatggcgaagctccatccttatccattcctttctctttgttaattattcgtgaaacatattaatcatacggcgaattgatattggaggtcaatttccaaagagtgtatagtgaataatatcacaaattacttaaaattttatatttaatatgcataataaggagtgagggtgttggcaaaagcaacaaatgaactaaaaacctctgaaaaaaatcggggggcggagcttgttgttgattgcttagtggagcaaggtgtcacacatgtttttggcattccgggtgcaaaaattgatgcagtatttgatgcgttaaaagataaaggacctgaactggttttatgccgtcacgaacagaacgctgcatttatggctgcggctgtcggaagactgactggaaaaccaggcgtttgtctcgttacttcaggcccgggggcatccaacttggcgaccggcttgttaacggctaatacagaaggtgatccggtagtggcgctggcgggtaacgtaattcgcgcagaccggttaaaacggacacaccaatcattggacaatgcggcgctatttcagccgattacaaaatacagtgtagaagtacaggaaacagggaatataccagaagcggtaacaaacgccttcagggcagcgtcagcaggtcaggcaggcgcggcttttgtgagctttccgcaggatgttgtgaatgaaatcacaaatgtgaaaaacgtacgcagcgtgccggcgccgaaacaaggccctgcaccggaagaggcggtcagcgcggctatcgcgaaaatccagacggcgaaacttcccgttctgttagtcggtatgaaaggcggaagaccggaagcggtaaaacaaatccgcaaactgcttgccaaaacaaaactgcctttcgtagaaacgtaccaaggggccggcacattgtccagagagctggaagaccaatatttcggccggatcggactgttccgcaaccagccgggcgatcttctgcttgaacaggcggatgtcgtattaacgatcggttatgatccgattgaatacgatccgaagttctggaacgtaaacggtgaccgtgctattatccatcttgacgaaatccaggccgatatcgatcatgcctatcagccggaattagaattattaggcgatatccccgctacggttaaacaaattgaacacgacgctgtgacatttgatatgggcagccgtgaaaaagaagtgctgagcgagttaaaacagatgctcacagacagcgagaaggcgccaagcgatcataaatccgacagagtgcatcctctgcaaatcgtccaagaactgcgcaatgcaattgatgacgacgtaaccgtcacttgcgatatcggttctcacgcgatctggatgtcccgctacttccgcgcttatgagccgctgaaactgttgatcagcaacggcatgcagacattgggcgtagcgcttccttgggcgattgccgccacattggtgaatccgggtgaaaaagtcgtatccgtttcaggagacggaggattcctgttctctgcaatggaattggaaacggcagtccgcttaaaagcgccgatcgttcaccttgtatggaatgacagcacatatgatatggtcgcattccagcaaatgaaaaaatataaccgtacatcatgcgtagatttcggaaacattgacatcgtaaaatatgcagaaagcttcggcgccaccggcttgcgcgttgagtcaccggaacagctggcagacgtgctgcaaaaaggcttgaacacagaaggccctgtcatcattgacattcctgtcgattacagtgacaatgtccatttatcaagcgacatgcttccgaagcaattcaaagaaaaaatgaaagcaaaagctctctagcactctgcgcaccatgacctgttttctaaaacagcccaatttaaaaggagtgaagggaatatgaaaaacgcaagcgacatccatatgatgagccgcggagaaaaaggctcacctgaggatcaaatctatcaagtatccaccatgacatctctgctggacggagtgtatgacggagattttgatatggctgacattccgaagttcggtgatttcgggatcggcacgttcaataaactggacggcgaattaatcggatttgacggcgaattttaccgtctgcgcggcgacggaacggctacgcctgttaaaggcggagacctgtcaccattctgctcattcacatttttcacgccggacatgacgcatacgatcgacggcgaaatgacccgtgaagaattcgagcaggaaatcgccagccttctgcctagtaaaaacttattttatgcgatccgtttagacggcgtatttaaaaaggtgcagacaagaacggtagaacgccaggagaaaccgtacgttccgatgattgaagcggtgaaaacacagcctgtgttcaactttgacgacattcagggtacaatcgccggcttctggacgccgggttacgcaaacggcatcgctgtttccggatatcacctgcacttcattgatgaaggacgcaattccgggggacacgtgtttgactatgtcattaaagattgtaaagtgaccatttctcaaaaaatgaatatgaacctcaagcttccgaatacggcggactttttcaacgcaaatttagataatccgaattttgcgaaggatattgaaacaaccgaaggaagcccggaataaaataaaaaagaaagcctcatttttctcgggggctttctttttatttggctgaaccggcaaagattaggtaaaatacagtcaaaagggaaaggtgtggtagctgtgaaagtattggtattagcggttcatcctgacatggacaactcagcggtcaataaggcgtggacagaagaattaaaaaatcatgatgacatcacggttcgtgagctttataaagaatatccggacgggaaaatagatggggaaaaggaacggcagctgtgtgaacagtatgaccggatcgtatttcaattcccgctgtactggtacagtgcgcctccgcttttaaaaacatggatggatcatgtgctggcgtatggctgggcttacggttccaaaggaaaggcgctgcacggcaaagaattgctgctggctgtttctgtaggtgccggagaggatgcatatcaggcaggcgggtccaaccatttttcactgagcgagctcttaaggccgtttcaggcaatggctaattttacgggaatgacctatttgccggctttcgcgatgtacggggttagcagcgccgatgctgcggctatccgtgacaacgccaaacgcctggcggattacataaagaagccattttagagtcgtatgcattcatcttcatccgacaatatttcctgagaaatatttcgaaccttagacgtttctgactgctcaagaaagaaaaaacggatttcgcgctgaatttgcgaaatccgttttgatattatgtcagtttttgcagatcttttgtgctgatatatcccgttgcgcccccgtaatcgacaagcgcccagccgaaatcaatgccgccgccggctgtctttttccatccgaggaaagaaacgctcgtgtttttggcaagggaagctgtgaccgcttgtttgtctgtatatacttttgtttttgccgtcgtttttacggttgttgcttctttaacaatataatgagtagatacaaatcctgtttttccgtttttataatgtacttttgcccagtcagcgttctggaatgaaacgatctttaagctgtcgcctaaatgaagggtatcagctctcggactggctgctgatgcttttgttctcacgttcaatgcttccgcggaaacgagataagagtcaagcgggtagctgtacagatcgtcaattttgaccgcttcttgcgcgtgtgtctcgggaagaggcgttattccggcagctgaagccgctgatattcccgctgcaagggtcagaatggatgccgctttggctgttttcttcatctgtatctctccttttacttcatcctttcacgttttaccggaagtctaaacatcagccggttatttttgcgtttgaagtttcaatggagcggaaatggtttttttgactttttttcctttgagcacctgctccgccgcttcggccgccagttttccgatcagctccggctgctgggcgaccgtggctgtcagcttcccgcttttaatggaagaaatcgcatctttatttccgtcgaaaccgacgaccaaaatgtgtttgcccgagctgttaatcgcttcgagcgccccgagtgccatttcatcattatgggcgaacacggctttgatatccgggtgtccctgcagcaggttttccatgacggtcaatccttttgtgcggtcaaaatctgccgcttgctttgttacgacatccagctttttgtcggcaatatgatgaaagcccgttccgcgttcccgtgtcgcggatgcgcccggcaccccttgcaattcagccactttggcgccttttccgagctgatcggcgaggtagtcagccgccatttctcctcctttgacattgtcagaggcgacaagcgtttcgactttgccgtgttcggctgaacgatccagcgcaatgacgggaatgccgagggaatttgccgattcgactgctgttgaaatcgctgatgaatcggtcggattgatcagcagcgcatcgactccctgctggatcaaatcttctacgtcatttgactgtttagatgaatcattttgggcatcgacaataatgaccttcatgccccgttttttggcttcctttacaacgccttcttttaatgaaacgaagaacggattgtttaatgtggagacggagagcccgatagtgaattcttttttatgttttgtgtttgacggttttgcccattgcggcggttcaagtgaacaggcggacagcaaaaacagtgataatgccgcgatcgtgatgatggctttcttcataatggtcctcctactatgccgattttttgcggtccagcagcaccgcgattaaaatgacgattcctttgacgacgagctgataaaacgatgatacgccgagaaggttcaagccgttgttcagcgtaccgataatcaaaaccccgatcagcgtaccgatgatgcgccctcgaccgccggacaggctcgttccgccgagaacgaccgctgcgatggcgtccagctcgtatgattctccggccgtcggctgtgcggaatttaagcgtgatgtcagaatcgctcccgccagcgccgataataaacctgtcagagaatagatcatgatcttgatgcggggcactttgattcccgatatcagcgccgctttctcattgccgccgatggcgtatgtccggcggccgaacggtgttttgtgcagaagaacccacagggccgcaaatgcaatcagcatcgtaatggcaggtacggggatgccgagaaaataaccgcgcccgaataattgaaatgcgtaatttgaaccgagccccgtaatcggatttccgtccgtatagacgagggtcagtccgcgaaagacggtcattgtcgccaaagtggcgatgaacggcgccatttttccttttgtgattaataatccgtttatcatgccgagtacggcgccgatcacgcagccgatgatgacggctaagatcgggtcgatgcctgagaccatcatacctgcgaccactgcgctcgataaggcgaggatggctccgacagagagatcaatgcctcccgttaaaatgacaaacgtcattccgaatgcaatcagagcgttaatcgcaacctgccgaagaagattgagaatattgagaggttcaagaaaactcgggtttaaaacggaaacgatcagcacaagaatcagtaagccgagaaacggaccgagtttttgcgtgaaggtatgaatggaaaatcgcttttgttcagttgatgttattggttcagttttcatactgctgccctcccgtggcaagtgtcatgatgtgttcttgtgttgcatctgccgcattgatttctccgctgatgcgcccttcgtggacgacgatgattctgtcactcatgccgagaatttccggcagctcggaagacaccatgatgatggcgactccgcgatcggtcagttcattcattaatgaatagatttcccttttcgcgcctacgtcgacgcctcttgtcggttcatcaaggatgaggactttcgggccgattccgatccatttggcgatgacgactttttgctgatttcctcctgataaatgccgggcggcggtttccggagatgcagtcttaatggtcagacgcttgatgagcagctcaacgaactccgcctcgcgttttcggtcaatgatgcctttcggagagaagctggtcaggttcggcaatgagatattttcacgaatggacgtatccagcagcagcccttcatctttgcggttctccgtaatcaggccgagtcccttgcggatggcatcgtacggaccccgaatgccggtttttcggccggaaatccagacctctccggaatcgagccggtcaattccgaacagcgccctcatgatttctgtccgtccggcacccattaagccggaaacgccgaggatttctccggcgctcacatggaaactgatctgtgaaaatcttcctttttttgaggcgtttttcacttcgagcaccttatcgccgagtgacggcgtgcgggtcggataccgatcggtcagctcccgcccgaccatttttttgaccacttcatcaaaatgagtatctttcatatgcgccgtatcgacagtgaggccgtcccgcataatggtgatccggtcgcaaattgaaaatatctcttccattcggtgagaaatatagacaatggatacgccgtcccgctttaacgccgtcatcacgtcaaacagtttgctgatttcccgttcggtcagcgccgcggtcggttcgtccataataatgacttcggcgtttgtcatcagcgctttggcaatctcaatcatttgctgctggccgacggaacattgtccggcttcccggtcaagaggaagagagactcccagtttttcaagctgtgattttgctagcgctttcattttcttcgtttccaaaacgccgaacgccgtcgtcagctctttgccgataaaaagattttcaagcaccgtcatgtccggccatatattcagttcctgatggataaaggcgattccgtgcttttcggcttcctttggattggagaaattcatatttgttccgtttatcgtaatgtttcccttgtcgagccggtagagcccggtgagcagattcattaacgtcgatttgcccgctccgttttctcccattaaagcgtggatttctcccggcagaagctcaaatgagacgccggatagcacttggtttttgccgaatgctttatgaatgtctgtcatgccgatgtgcatgctggatcccttctttctagaaaatcacacccgcctgcaggatgcagttggcgtatggtgtcatttcacccgtccggatgacggcttttgctttctgtgtgagccgtttgaattccgagtgggacatgtactcgatcgtctgcgctgagaaatggctttctatgaaacttgcattctcaggattttcgtctttgatctcggaggcggccatcaccttttcgacggccatctccccggctaccaggctggtcacatcccgaaaggcgggaatgcccgccgttaaggacaaatcaattttagggacgccgtcagggacggggagacccgcatcggcgatcgcgatgaggtctgtatgcccgagatcggctaatactttggcaatgtggctgtttaacattccgtgttttttcatgacagcagctcctcaacttcttttctgaccggcatcccgccttgggcgccgaagtgctgcacggacagggaggcggcgcggttggcgaacaggagcgcttgctcgatgtcccgtccttccgcgagcgcgacggcaagtgccgcattaaaggtatcgccggcacccgtcgtgtcgaccgcttctgcagggaagccgggaacaagccgttccgcggtgccgtctgagtagcgtacgccttgttttccttcggtaatgaacagtttgccgggatagccggcgagcgcttcttctttcgtccggtcaggaaataaaatggatgcttcatgttcgttcggcgtaagatatgcggcattctcaatcgtcgattgtttcagcgggcgggccggcgcgggattcaggataaccggaatttggtgcgcgcggcagtagctgcacacttcttcaacagtttcttcaggaatctcctgctggatcagcacgatatcaatgccgggaagtttttccagcgcacttttggcataatcgggtgagatgtcatcgtttgcgccttttacgacgacgatgctgttgtctccttctgcgagcacaatatgagccgttccgctttttttatgtgtaaccgtttccatatagtccgtattgacaccgtttgccttcaggttttcaataatcgcttttccgtagctgtcactgccagcttttcctaccatatatacgtttgcgcccagacgggaagcggctacggcctggtttgcgccttttcccccgggcacggtttgaaagtctgtgcccagtacggtttctccggctttcggacgccgttcggatgtgacgaccagatccatagaacagcttccgataacacaaatttcactcatggtgatcatcctttctcgtcgtttgtcttcttatataagtcacgggcagttgaatggccgtctctttcggcggctctttctttatcaattgcagcagcaggtttgccgcttgttttcccatctcatatgcaggctggcggatggttgaaagcggcggaaacaaaagcctgctctgcggaatatcgtcgtatccgatgatctgaatctcctccggaacttttttgccgagccgcagcgcctcatggaggacggcagccgccgcaatatcgttgctggcaatgactccgtcggtttcggggtatgctgcaaacaatttttctgctaaaacggcggcatccttgatagaaaatgaagcggcggagatgacattgaactgcgcgcccgctttatacagcacatcaagtgcgccgttaaaacgttcctgagcggtcggaaggtggcctgggcctttgacaagcgtgatgcttgtgcttttgccgcgaagcatttcctcagccgcccgttttccgcctgcccgcccgtcactgaatacggatggggcgccttcttttgtccggtccagaaatacgaccgggtaaaggctgccgctgtattcgggaaggtcggggtaatgggtggccgccaaaataccggcaacttgattttgtttaaatgtttgcaggtagtcgagttctttttccaattcttcatcgctgttgccgatgatcagccggtatccttcccgctgcagctcgtcttcagcgccgcgggcaagctgcgggaaaaaggggttcgtaatatccggaagcaaaagcccgaccagtctggattctcttttataaagagagcgggcaacttcattcggataataattcagcttctccatggcaagcatgaccttcgttcgtgtatcttcatggacgtagccgttgtcattgaggacacgcgagaccgtggcaacagagacgccggcagcgcctgcgacatctttaatcgttaccaacaaacactcccccttcatttatgtaaccgtttacacaaaaagagtaccacgaatcatttcggttggcaacaaaaaaagagaccggggtctcttttagttcacgatgccgatttgcgagatattcactttgatatcagggattatctcgatggaaggatagacctcacgccaattgagccgcttgccccgctcataataatgggtttgatatttccggccgatgccgaggatatccgagttgtgctcctgaatatggctgatcaccgatctggcctggctgttcaaatttgctgatgcttgtttgttcatttggtcgattgccgtataagaattcagtttgtccttcggatattccaagacgcgtgcattcagctttaaacggattttcacttttatatgctgcggatctgtatctataaatacaatctttcgcgtggcatccgtgatgccgagagaaagataattttcaatatccattttgtatttgtcccacagcttcagattaatattagccgatttattaaattgcccgcttaaaagggtcaggagggtcgaatcctgaccgagcacctcagtcactttccgctgtccgctgaacagggcagaaccctctacctttatcgtctgtccgttaatcgataaataaggaagggcgaaatccttatcagccgtcagcatgcttgaacggatggattgcaaattttccatgctgatatttgattccgcattagcgcttgttaataaattcgttaaatacttgctgacgatcaatttctgccggacgatcagcttcagcacttcaatcgcctcgccgtcttttacaaccgccggatgagcgagaagcggacttttcggatctctgtaaaagacatcgagataaggaaaaagcggtttttccgccattttctcaccgattaataagactctttgcttggacgtgtcaatgcgctggtcgacaagcttatccaattgaaaccgcgcttcacggatggtgtgtccggaagcgctgagcaccgtcgtaatgaatgagccgcccgtttcctgttccgcctgggaggactgaaccttccgataggtaatgccgattttatttttaccgtcatgatcaacatcaaggcttgcggtcagcacgagagaaatatctttcaacaaattttgatcccagcagccggcaagtgtcaggcttgcgcacatgagactgataagaaccgcttttttaatgcgcatggcggacaccctttttgcgtacaaggacaatcaataccataaacaacggaaacaaatacacaaacacaatatcggaaatgcggaaaaactgatccagctgctgtatcgttttatctgtgcttgtggcccaaatagacagaaggaagacgagcagggccagcggataaacaaaccggctgtgatctttttgattgaacagcttggcgatgccggtgcttgccaagtaaaacacgttggccagcgttgaaaagacggtcacgaaccaaaacgtcaaaaagagcagatccgtccgttcgataattctgaatgaaacggtttttaacaggtacagcacaggctccgggatcatttttatttcttcggggctgatggtgacaaagcaagtaagagtgatatacaggtaataaaggataatcaagccgtttgaaatcgtcagtattttgtagcgctggctgacggtgcagttgataaggggcccgatcacaagcgccgcctgaaagccggtaatgctgacaagtgtttgctgcaccccggtaagcatgtcttttgcggttccgtgaaaaatcggcataatgtatgtgatatcggcttttcccagtgtgtataaaagcggcagagagatcagcagcaaaaacggcgttaaaataaagctgaacctcgcgatcgcattcagcggggcttgggcgatatagacagaaccgaggatcagcattaagctgatcacccaattcggagtctgagggagcacccagatatccaataaccgtgtaaatacagaaagaatgagcgtgcagagaaacgcgaaatataaaatatacagcacctgcacccctttgccggcaagtgttccgaacacctcctccagcatttcatacaggttcagcttcggaaaccggtgaaataatatcatatacaggctgaaggtaagctggacgagcaatccggtaagcagaatggaaatccatccgctgcttcccgatttcatcatcagtaaatggggcagcgccaaaatgccgatgctgatctgcgtctgattaatgaaaaacacgccttgaagccggctgatttttttaggcttcatcttttctccacccccgaacatgttttatctgctttgaatcttgcggtctcaaataaaaaggccttcttttaataaaccaggccggcagccggataaatgcatcctttaagtcactgaaatgaaacggcgtcagagatgataaatacggaacgccgagggattcaagcttgcacaggttcatcagaataagtccgaagccgaatgcgatgccgataaaaccgaacgaggatgccagaaacataagcggaaatctgagcgttcgaatggacgtgctcatttcatatgaaggaagcacaaaagaagaaacggccgtaacggccacgacgataatcatcatattagaaatgagtcccgcctgaacgactgcgtcaccgatcacgagaccgccgacaatgccgatcgtctgactgatcggtttcggcagcctgataccggcttcgcggatcagctcaatcgtaatctccataatcatggcctctatcagcggagggaagggaatatcaacaatcgaatttttcatggtgataatcaaatcgttgggaatgacttcaaaatgaaacgcaatcagcgcgatataaaaagcgggcagtgtaatcgcgatcataaaggcgaaaaatctcagcactctcaaaaaactggcggaaatccacctcgtgctgtagtcatccggcgattgaaaaaaggaaaagaacgtgatcggcgcaatcaaggccgacgggctgccatccatcatgatcagcacacagccttccatcacgcatgcttttgctttatccggccgttccgtatgaacgatctgcggaaaaatggaaaacgaattatcttctatcgactcctcgataattccgggcgcaagcacgctgtctatacgcaggtatgacaggcgccgcttcacttcctccacaatctccggattggcgatattctcaacaaagataaccgcaacctttgatttggctctttccccgatatccatataatgaacggagagatggcggtcctgtatgtgaaaccgcagctgatgaatgttcgtttccaaactttccacaaacccgtcatgggcgccgcggacgatactttcagattcgggttccataatggaacgcagcggattctgcccgacggaaaacagcttcgctttccttgatgcatcgctgagaaaaacaacctggcctgccaaaatcccgtcaatgagttttctggtttcatccgtttccgcactgctgacggcattcatcgtttcctcaagcggaccgttctgcagggtgtcgcttaacagaaactcattcagcttctgttcttctatcatttgttcaatataaaagaaagcggtatgacggtcctgcagtttgatccttcgtattttaaaatcaccgcaaacacacatcagctcctgcatttcccgtacagccgattcaaaatcgccggaaatccgcttgttttgtttatccgcagacatcagaccgcctcctttcccggttatttgtagttttcagcgggtattccttttttatgcattttataaaatagaggagtttctcgacgttttaccaagaacttcacaattatggatgaatatttcttgaacgaatataaagatttattaaaattatttcaaaagagtgataaatgtcctgtaaatgctttaaaaggagataggctttccgcatataaaatgtgtatttcttgtaaacactccggacccgtctttttctgtcacgtaccagtcattccgctagttattttggaatgggactgaaagcaggatacgggggaaaaatgaatgactttaagaccttatccttaacaaaacaggcagtctgcacacagcggacatagagtcccgaaacgtatgcgcagtgcggaaaacgctgatataacaggctgtaaaagatggattatcattacatctttttcttccggaacgcgtatagtcccattggtccaaatgaatttatgtgcggaaatgtaaacgcatacatttttcttttaaaaaattgaagtaaggtttaagtcctgcctattcccaaaaaaagcaattcgataataggaagaatagcgtcactaatagagaagtttggctcagtgaaagcgggaagattatgttacataatgccgattgagaattcatagtgaagctatatactgatgaatgaatttatcaatacagaaggagatgtcaaaaatcaatgtggttactcattatagcctgtgctgccgtactaatcatcggaatcattgaaaaaaggcggcatcagaagaatatcgatgctctgccagtacgcgtcaatattaatggtatccgcggaaagtcaaccgtaacgaggctgacgaccggaatactgatggaggcgggctacaaaacagtcggaaaaacgacgggaacagatgcaaggatgatctattgggatacacctgaggagaaaccgatcaaacggaaaccgcagggcccgaatatcggcgagcaaaaagaagtaatgaaggaaaccgtagaacggggcgccaatgccattgtcagtgaatgtatggcagtaaacccggattatcagattatctttcaggaagaactccttcaagccaacatcggcgtcatcgtgaatgtgcttgaagaccatatggatgtcatggggccgacgcttgatgagattgctgaagcttttaccgcgacgataccgtataacggtcaccttgtcattacagacagtgaatacacagacttctttaaagaaaaagccgcagagcggaataccgaggtcattattgcggataactctaaaattacagatgaataccttcgaaaatttgaatatatggtctttcctgataacgcttccctggcgctcggcgttgcccaggctcttgggatagatgaagaaacggcgtttaaaggaatgctgaacgcgccgcctgatcctggcgccatgagaatcctgccgctgctcagcacgaaggagcccggtcatttcgtaaacggctttgccgcaaatgatgcatcttctactttaaatatatggaaacgtgtaaaggaaatcggctacccgacagatgaaccgatcgtcatcatgaactgccgcgccgaccgtgtggacagaacgattcagttcgcaaacgacgtgcttccgtacattaaaacgaaggaactcatactcatcggcgagacgacagaaccgatcgtcagagcttatgaagaaggcaagattcctgccgatacactgcacgatctggaatataaatcaacagacgaaatcatggacgtgctgaaaacaagaatgcaaaaccgtgtcatatatggcgtcggcaatatccacggttcagcggaaccattaattgaaaaaatccaagagtataaggtgaaacagctcgttagctaggaggaaaaggataaatgttcggatcagatttatacatttcacttattttaggcgtgttaatcagtttaattttcgcggaaaaaacaggtatcgtacctgccggtttagttgtgccgggttatttagggctcgtttttaaccagccggtctttattttactcgtactgctggtgagtcttcttacatacgtgatcgtcaaatacggtttatccagatttatgatattgtacggacgcagaaaattcgcagctatgctgataacgggaatctgcttaaaaatcgcccttgattttctttacccgatcgtaccgtttgagatatcagaattccgcggaatcggtatcatcgtaccgggtctgatcgccaataccattcagaaacagggattaacgattactttcgccagcacgctgttcttaagcggcgcaacttttgccattatgtttgcttactacttaatctaatgtaaggtgtgtcaaacgatgaaaaaacaattaagctttcaagaaaaactgctgaagctgaccaaacagcagaaaaagaagaccaatcttcacgtttttatcgcgctgccaatcgtcttttgcctgatgttcgtctgcatcctgacagggaaggcggaaacgccgagtgtgaaaagaaatgccgatgaccttgtatcagcctcatttgtcggagatattatgatgggccggaatgtcgagaaagtgacaaagcataaaggcacggagagtgtcttccgttatgcaaagccattcttcgaatcatccgactatgtgtcagggaactttgaaaacccggttacatataaaaagaactacaaagaagcagaaaaaaatatccaccttcagtcaaacaaagatgccgtaaaagtattgaaggacatgaatttcacagttctcacggcagccaacaaccatgcgatggattacggccctcaaggaatgcgggatacggttgaagagttttcaaagcaaaatcttgaacttgtcggagcaggcctcacgctgaaggaagccgagcagaacatttcttatcaagatgtaaacggaatcaaaatcgcaacactgggtttcactgatgtttccggaaaaggttttgcagctaaacgaaatgcgccgggtgtgcttccggccgatccagagctgtttattccgatgatttctaaagccaaaaagaaagccgatcttgtcattgttcaaacacactggggacaggaatacgataatgatccgaatgacagacagcgccaattggcaagagcaatgtccgatgccggagcggatattatcgtgggacaccatccgcacgtgctggaaccgatcgaaatgtaccacggcaccgttattttctacagcctgggcaacttcgtattcgaccaggggtggacaagaacgagagacacggcgcttgttcaatatcatctccagaaaaacggcacgggacgctttgaagtcacgccgatgaacattcatgaagcaacgcctgcaccggttaaaaaaggcagcatcaatcataaaacgatcgtacgtgaactgacgaaagaatcgaatttcaagtggagcgtcaaggatggaaaattaacgtttgatgtggatcacagcgatatcttaaaaaagaaagcggagtgaaaaacaaatgaaaatcattaaagcgggatggccgtttgccgcgatcattatggtatttatgtttatgtctgcgtttaaatacaatgatcagctcacagatcaggaaaaacaaaaaattgacacggaaatgcaaaaaattcagcaagaggacacagcgggcgcaaaataagcgcatgattccgcttgccggcatattgtttgttccgaatccagtaaagaatgcccatatcgggcattctttttttgtgtgctctcctaaacatttgttaaaagttaccgatgtaaaaactactaaaaatgaggagagtgaatagaaaacatgctcacaagctggaggaagtacatccttgccggccttatgatttgtcttgtggcacctgcagtaacgagaacggaaattgccgaagcggattctcaagtttctgtcctgatcgtttcagacgcgcaaaaacttgtcggaaataaatatgtttacggaggcgaagagcctgaggacggttttgacccgtccggattgatgcattatcttttcagcaggcagaacatccatctgccgagaacggtcagtgatcaatggaaagtcggagccgccgtcaaagaaaatgaccttttaccgggagatcttgtgtttttcaaaaagtcagattcaacacaaaacgcggccgtccatgacggtctgtatatcggaaacggagagatgatacacagttctccgtcagaaggcgtaaccgtcacacgctttcaaaaaagcagttattggatgaatttatatcttggcgcaaagcggatgacaaaagatccggaactggctgatgatccgatcgttcaggaggcagcccgttacctcgacattccgtatgtattcggcggaagcacgcctgaggcgggattcgactgttcggggctggtccaatatgtttttgaaaacaagcttcacatttacctgccgagatctgcggaacagcagtggctggtcggtgagaaaatcaaactgagcgacataaagcccggggacgtgatttatttcagcgatacgtataaaaaaggaatttcccatgcgggcatttatgcgggagagggaaggttcatccaagcaagccgctccgaaaaagtcaccatttcttacttggcggaagattattggaaaaaacatttcacaggggtgcgccgattcagcaatttagccatttctaaagacaatcccgttgtgtccacagcggccgatcatatcggaatttcttatctgaaaggcggcgcttcaccggaaaccggctttgatacggcgggatttgttcaatacatctatcaaaaagcgaaaggaatcagcctgccgcgttatgccgacaagcagatgcaggcgggcgttccggtcgataaacaagatctgaagcccggcgatctggtcttctttaaagcggaaagcctgaatccggccatttatatcgggaacggacaagtgattcatgtcaccgtgtccgcaggtgttaccataacaaatatgaacacaagcgcttattggaaggacaaatatgcgggcggcatccggcttccgtaaaaaaagacgtcagagagtgtctctgacgtctttttcttttaccgtttcggcgctctgtatccggccgctatcgcatcctctacagaacagaacatttccgcgggatctgtcgtccggtcgtagtacgtacttcccggcgtgtgataaatgccgtaccggctgcctttaatgtcgcatccctgtgaggtgccggctgctttcgtttcggcatgtcctccggaggaaggggcgttgttttgcgccgtttccgcgttttcggatgtttttgtttctgctttctgccgctttaaagttttattttctgactgaagcgtttcagcggtcttttcgagcttcttttgtgaattttttaatttctcattgtcttgtttgagtgatttgtttgtttttttcagctcgcttatctcttggctgagtttgctgagtttttcttcattgccggcttcagcttcggatttctccttttcggctgcggcactgatgctttcatattttttctcaagcgcctggtgttccttcgtcaatttttgataagccgtatcaagggtgctgtatttctcctctgccttcacggccgaggcgtccggctctgcgagggatgcaccggtcagaagcaggataaatccgccgatgagaagaggccaaaacagcttttttgaaaaatgtttttctttttttgccgctttgcatatgagatgaaaaattccgtatccgactgcgcagagaaaagctaaaaatcctataatagcgattgcattcgacatcatgaaactccttttttagaaaacatgaaaaagccaggccgtgaaagacctgacttttaccttttattgcccattgtcgagaagccggttgatgaaatatgcgacgccgttttcatcgttgctttttgtaatataggtgcttttttctttcagttcatcaatcgcattgcccatagcgatgcggtttcccgccgcttcaaacatggagaaatcattcgggctgtcgccgatggcgtaaatatcctgtttttcaattccgtacagtgaggcaagctccgtcagagcacgtccctttccggaaccggcagggaggatttcgataatgtgttttccggaagatgtctgggataatttccgatgatgtgtaatttcttctttggcgtttctcagtttttccatatcaaaagagaaacaaagaagcttgtaaacatgttcgtctccgttaaaaatcgcctgtatatcctgtacgggtttaatgccgaattgtttgaactgcgtctttgcgccctcccataatgtctgaatatcttccttaggattggcgcttttcagaatgtccagttctgcctgcagtttggactcgccgtcaaacggggacagcagatgatcatctgtatagacctcaaagtaaatgtctttgtccgttaaataagcggcgatatccttcccggcctgctgatccattaagagccggctgacgaggcggtatcctttgtcatggactgtcccgccgtttgccgcaatgatcggaatatccaaatccttcaagagcgcttttacatcaaacgtggctctgcccgtgcagatggccacgagaatgcccgcttcatccgctctttgtaaagccgctctgttttccggagaaatcacactgtccgaattcagtaatgtgccgtctaagtcaatggctatcaatttcatatgtatggatgccctccttaaaaataaagctgcttcatgtagtatgttcagctttgtgcgaaatcagcagaaagccgtcagttaaaaggctataccttcatgtcctttttttcaacagaaaaacggcgggatttgctaatcccgccgtgacatcttacgcgtctaaatcattttttaatttcgtttttacttcttgaaggttttcctcattcagcttgaagtaataaatatttttgccgtactgaggagtgtaaatgtagctgtctgaacctgtcagctgcaaagaattcaccgatttcagcgatgtgataaacgggaacagaccgatggcgtcattaagagataagttcatttttaagtttttccctaagctgtcgacgatatcgtcataagatgggatcgagcttaacgatttagattttttaataatggcgctcagcacttccatctgtctttgtccgcgcatcagatcggtgtccgctttgcgtgttcttacataagccagtgcctgctcaccgtcaagcgtctggacgcccggcttcagcacgacttttccttttgtatcgactttaatacgatcggcaattttctggcttttcacatttaccgtaacgccgttcaactcattgacgacatcgcggaacgcgtcgaagttgctttcaaccacataatctaccggaatatcaaacatgttttctactgttttataagttaaattataaccgccgtaagcatgtgcgtgcgcgaatttgtcatagccgtgtcccgggatgttgacataggaatcccgcggaatgctgagcatcgtcgctgttttctttttccggttgaaggtgacgagcacgttggcgtcacttcttgcgtcatctactgattcacccttattgtcacgggcgtctattcctaaaagcaatacggtgaaagaatccttcttcgggtcaaattctttgatccgttttacggactggtcgccgcggtcaaggctgacgtgcgcttctttggtcgcattattcaatttcacaaatgcgtaggtgccgacggaaccggcgatcaccaataagaaagcggcgaataccagtacaaatttcacccattttctgaggcgtcttttcttttttctgcgttgagatcgttcttccatatcattacctctcgtttctattctttgtgaagcgtaccataattgttgactcggagcaactctgcaaatgagaaaattctaaatctttctctctatttcgacaacatctactgttatttttgcatcaggttcacattatattggacggcaggaagcgggaaatgtttcgtcgctttgtgaaaaataatcagtaaaataatggatattaacggtgcggaaggtttgaaacgatcggaaacaggcaaaagaagcagtagaacaattccgcgcggatacagcgttggatgaagggagtctatataacatgaaaagcatacactcgaataaatggctctattttttcggcgctctcgggggcgcgttatacggatatgataccggagtcatttccggagctattttatttatgaaaaaagaactgggactgaacgcctttacagaaggcctcgtcgtcagttcgttattggcgggggcgattctcggatcgggattcgccggcaaactgaccgaccggttcggcaggcggaaggccatcatgggagcggcgctgctgttttgtataggcggattaggagtcgcttttgccccgaatacagaggtgatggttcttttccggattattctcggactggctgtcggaacatcgacaacgatcgtcccgctctatttatcggagctggctccgaagcataaacggggggcgctttcttcgctgaatcagctgatgattacggtcggaatcctcgtttcttatatcgtgaactatatatttgccgatgcaggcgcttggcgctggatgcttggacttgcggttgtgccgtcagtcattctgctgatcggaatcttatttatgccggaaagcccgcgctggctgtttacgatcggcaaagaagagaaagcaagagaaatcctttcatcattgcggggaacgaagaatattgatgatgagattgatcagatgaaagaagcggaaaaggaaaacgaaggcggcttgaaagaattgtttgagccgtgggtgagacccgcgctgattgccggcctcggacttgcctttttgcagcaattcatcgggacaaatacaattatttattacgcaccgaaaacatttaccagtgtcgggttcggcaattccgcgtctatattgggaacggtcggaatcggcgccgtcaatgtcatcatgacgcttgcggctattaaagtcattgataagatcggccggaagccgctgctgctggccggaaatgcgggaatggtcatcagtctgctcgtattggccgcggtcaatcttttctttgaacattcagcagccgcatcatggacaacggtgatttgtttaggcctgtttatcattgtgtttgcggtcagctgggggcctgccgtgtgggtcatgcttcctgaattattcccgctgcatgtccggggtatcgggacgggtgtctccactttgatgctgcatgccggaacattgattgtctcattaacctatccgatgctaatggaagcagtcggcatcagctatttatttctcatttatgccgctatcggaataatggcattcctgttcgtccggtttaaagtgaccgagacgaaggggaaaagccttgaagaaattgagcaggatctgaaaagccgtaacggaggctcgggatcagaatcaaatcggcggacagttcatccgtaatattcagttttaggggggcggttattcaccggcccctcaaaacggatgcgtgcgggcgcccgcacggtcacataaatgacggggatatgtcatacgttgtataaagtcacgataaaggcggggatgccggtgaaaacgagtattattatccttacatataatgaacttgagctgacgaaaaaatgtctggccagcattgaacgatacaccgacaaagataagattgaactgattatagttgacaacggttcctcagacggaacgagagaatacatatcaaatctgcctgacgtcaaagtcatccttaatgaaaaaaacctcgggttcgccaaggggtgcaaccagggaatcgaagcggcagggggagaaaatctgctgtttctgaacaacgatacgatggtcacgaaaaattggctcacctccatgctgagggtgctgtatcaatctgaaaaaaccggtatggtcgggcccgtcagcaactatgtcagcggcgcgcaaatgatccatgacgcgtatcaatcgcttgatgagctggagtcattcgcggaggcgtattgtgcacgggaaaagcatcaaacaaagcgggtgctgcgccttgtcggcttctgtcttctggtgaaaaaaagcgtcattgaagacatcggcccgtttgatgagcaattcggatacggttcttttgaagatgatgacctatgtctgcgcgccctgcaaaaaggatacagcctgcacatcgctctcgatgcctttgtgcatcaccacgggcatgcgacgtttacggctaatcaggatatcaatatcaatcagttatattcggagaaccgccagcgttttacggaaaaatggggcactgattttacgtactttactcatccgagaccggaaattgcggagctcgttccccgggaggcgaaacggatacttgatgtcggctgcggtgcgggagctacggggctggaacttcaaaacagacagccttgcgaactgtacggaatagaactgcacccgctggcggcgcaagcggcaaaaggacattatgaagcggtgctgcaggaagatgtcgaaaaagtgaagctgccttatccggaaggcttttttgattgcatcattttcgcggacatccttgagcacttaaaagacccgtggcgcgtcattgaaacgtactcatcctatttgtcgcctgccggatcaatcgtttgcagcattccgaatatttcccacgccgaagcgctgttcccgcttctgctcggggactggacatacagagacgccgggattctcgaccgcacccacttgcggttttttacgccgcagacggtgcgcacgctctttccggaagagacatttgacgtgaaaaagcagtcctatacgtatgttcacgtggatgagcgggtgcagctgtttttacaggaaatcacacgaatggcgcaatcgatgcaatttccggtgacacagctgcccgaacaaagccggatttatcagattctccttcgtgtcgaaaaaacacgctgaaggctaccgccccatcgttccgaagttggtaatctgaatggaaacatcatagtcaaaggccgcttcggagaaggtttcatcccagtgatgcttcactttcttccaatagtcgggatattgaatgcggactctgtcagaaaagaagacagggtccgtttcatattgattctgcagcttatcgatgacttctttcatatcgcttttcagttttttttcgaaaaccttttccagcccgtttaaatagtgctgatcgaatgaatcttctccggcatattgatcctctgacaaaagtccttttgttttcaccgctacgtgaaacgacagcttcccgtttttcagcaggggggtgatggaggatgttgattttttgatctcgaaggtaattgggtgccctcctttatccaaagcgggcagcacgccgccctgtatcgtccccgtcagccaattcaggctttgtacttcgtatgatgacagaaagcctgccaatctgttttgttttccgtttttgataatggccgctccgtcatacaccgtttttcctttttgattgctgacggcctgaatgagaaaactgagtttattatggcagtaaatcgaagctctcccgattcggagcggttttaaaatcttcccgttgtagccgccgttgttcgtaaggtcgatcagcttttccgcgggcatgggctgctgctgattcggcgtcggctctgtcagaatatcggccgctttgcctcttgccgcgaagagatagctgctccgccttaattcatcatcacggataaaatggttcatcatctgcagtatattttggtcggccagcaatttgtcgctgaatatcagcacttttaaatgatcgctgtaaacgggcggatcttttaaagcgacttcactgacggcttcaagaatggtatccccccgcgacgtcacattgacaaacacgggccggccggaagcctggctgttttcactttggggcagcaggttttgataggttaatttatatcggcggtcactcgtctcgtctatcgccagcccccgggcgaaagatagcttttcgacttccttcgcatcccagcaccctgaaagcgtcatcagtatgaaaagcgccgccgcccattttacgaaatgtgtcatgacgtctgtttcctcccggctatttttttcatccagctgacaaaccagatgagaaaaggaatcataatgacggcaaaaaacgcatatccgagaatattcgcgaatgcaaacacactgttgatatcatcagggtacattgaaaggccgaatgtcactgccaataagccccccagcagccaggcattgtttttatttttcagtctgaaaatggtgtttaacccgagatgcgctcctttaaaagaaccgagcatacaggtgaactgctggcatgtccacgtaattaaaagaaagatatcaaacctttcgatgaaaataccgcggatttccaaggcgtgaatcagggaaatggtcggatatgtcaccgttttggcttcagcgatcgacatacagccgattacgacaagcagcgtaaagctgtaaaataagcctgcgcatgcgatgccgaagacggcagcctttttcgcctgcttcggatttttcataaacggcaccagataaagaatcacctcaagtcctgaaaaatacagaagggtacgcggaaacagctcaaaaaagcttttgtagcctccttccatgaccgggcggatgaaatccagtttaaacagtctcaggctgaatatgagcagcgtaatcagaatgacgatcgcaatcggaaagagataagcatagagttttgaaatgggatacaccccgccggtcacatggtagatgccgaccgccagaaagatgaatatgacgacacccatcggcgtatttttcagtaaaaagtaattgatgacctcaccgagaaaacgggcttgaaaacagacggtgacgacaaaataacagctgatgaataaattaagaagagaaccgatggcgcgtcccataatgctttgattcagctcataaatggtttccccgctgtttttctgcaaaaatggcataaagagcaggacgatgccgataaacacgagactctgcacaagaataatgatccatccgctcggactgtccgctgctgcggcggagcgcggcagtgttaacacgcccgctccgatcattgttccgcttaccatgagaagtgtctgcataaacgacagcttgtcttccggttttttcatggtgatcacctttgcttgattttatctttcgtctcttttctggtcggccgttttttcaaaagaggcgtcggcagtctgacgatcgtatcttttaagtcctgtcccggctgcgccatgatcggaataagatagtcctggccgaagcttttcaggcgcatcagatggccgacgacaagcagataacacatgatcagtccgtataaacctaatatcgccgacaaaatcatcgaaaaaatacggatgagtctcagcggaaaattgaacgcataggagggcgccgtaaaagaagccaatgccgtaacggatacgataatgaccatcatcgcgctgacgatgttcgcctgaacggcggcctgcccgatcaccacgcccccgatcaggccgatcgtctgtccgatcggcttcggcagcctgagtccggcttctctgatcatctcaatcgtaaaaatcataataaacgcttcaacaaaagggggaaacggaacattcaatctgcttccggcaatcgtcaccgccattctcgtcggcaaaagccccgtgtgaaacgtaacgagcgatatgtaaaggccgggtaaataaatcgtgattaaaatgcatgtataccgaagcagcctgagaaagttaaccggaacccaccgctgattataatcgtcaggtgagtggataaattcatcaatggtagccggcaccaaaagggtaaaaggcgttccgtctacaagaatggagacccttccttccaaaagagcgcccataacccggtcgggccgttcggtcgtcaagacggtcgggaaaatggaatacgtgttatcttcaataagctgctcgatcgttcctgattccggaatgtcatcaatggtgatcgaatccagtcttttcatcacttcttttacaacatcatcaggcgcaatatcccgaatgtaggcaacggcgatccgcttttttgtccgttcgccgagtgtgatctctttgatctggaggttgggatcaccggactgctcgcgcaaaagcgccgtattcgttcggagcttttcgacaaaacctatcctaggtccccgttcaagcacttctgaagccggttcttcaatatcacgcattttaaatgtttccgtttcaaacgaaagggcttcctcccatccctccgccagcaaaaccgatttgccggaaaaaatgtctgcctccgcgtccttaagtgaagaaagccgggtgtgacgatagccgaaagagatggatgacggcggtatttcagccggttcctcttgatgcagggcggccgcctgcacgggcgaaataatatattccgcaagcaattgattgtcggtcagtccgtctatatatataaggcaggcgtcacatttgccgtttccgtacgtaaacgaataaaacatcatgtcatcgctttggccgatccgttttttcagcgcttcaaggtttttgccgagctccgcatgtatcgtcataatgttcccccctttccatcagttattttaatttgcgacaaacaaggcattttattctggaataggaaatgactgagcattccgccccatccgaatggtataatgagcaggtcagccattttatacatattgtttttaaccgcggctccctccgtgttttaaaaaagacacagggggaatgggatatgagccgctttttaaggggaggggaacgaacatgacgcaagagccgatttttctacagcctgtatgtaaagaaaaaatatggggcggcacgttattacgcgaacgattcggatatgacataccttcagaaacaaccggcgaatgctgggcgatatcagcccatccgcacggaatgagcacggtcaaaagcggtccgtatcaagggaaaaccttgatggacctgtgggatcagcatagagagttattcggcggaacggaaggggaccggtttccgctgctgactaaaatactggacgccaaacatcatctgtccgttaaagtccatcctgacgattatgacgccgaggagcatggacagggcgaaacggggaaatctgagtgctggtacattattgactgtaaagaaaatgcggaaatcatatatggtcatacggcccgttcgaaagcggaacttgtcaccatgattaacagcggtgactgggaaggcctgctgcgccgcgtgaagatcaaacccggcgatttttattatgtgccgagcggaaccatccatgccatttgcgccggagcgctcgtgctggaaatacagcagaattcagacgccgcctaccggatatatgattacgggcgtacagatcaaaacggcggtgcgcgtgagctgcatatccgcgatgccgtcaacgccgccaccgttcctcatgtggacggatttttggatgaatcaactgaaacgagaaaaggcatcaccattaaaacctttgtgcagggagaatatttttctgtatacaaatgggatatcagcgggacggcggaaatgacccaggacgctccgtttatgttatgcagcgtcacagaaggaagcggctccatcatctttgaaggcaagtccgccaagcttgaaaaaggcgcgcatttcatactgccggatcagatgcctgactttacgataaacggagattgcacgatcatcgtttctcatatataaaaccaaacttaatcccagctctgggattaagttttttttatttggataattggatgatttctctctgtaaaaatgaagaaagcgggccgataaataaactagtttgatagaaaccaattgaatcagaaagaggagaaggaatgaaaaagagattcgttgcacctatgttattgtccgccgttttccttgtctttagcaccgttacacagcacgccgaggccgcatacagcgactactccgtttacgagctggaaacgaagcagcaatttgcttctgagaacgaggcgcttcaagcggcagcgaaattgaaaaaggatacggggtggcaggctgacgcaaagaaagccggaaatgcgccgctcacttatcaaatctcagcttcaggcttacacgatgaaacggatgcgaaaaccgtgctgaaagattttacgaagcagacgggcgtggccggcacttacagcgcaagcggaagcaaacagccgtacgtgaccgtcacatcaggcgttctatcagacgagcggcagacgaaaaatcttcttgccgaactgacgaaaaaaacgggcgtgaccggcgccgtcaagccggcggggacaaaacagccgtataagcaggtcgtgacttctgagatggcggccgatgcggatgcaaaagcgctctcgcaagcgttgacgaagcagacgggcgtgaaagcgtcataccgtcagatcaaacgggaaacagcccggtttcagatccaatcgggaacaatctccggcgatcaaaaagccgctcaaattcaaactgattttcaaaaggaaacaggattgcagtcgtcgctgaaagtcacggcaaaggccagtccgaatatcaccgtgacagcctctgacattttaaatgcaaataatgcggcaggtttagcgaaacagctgcagcagaaaacaggcgtcaaagggaacgttcaaaagtatgcccaaagcaaaacagcaaccgtgtataacgtgcagtcaggatattttaacggagtaagcgccgtacaaaatgctatcacccaaatcaagaagaatacgggtgtcagcggaagctatcaaaaagccggcaagaagaataattacacggtcgcgatgagcggactgacggctaaacagctgcaaagcgtgcaagctttctttaaaaagaaaaaatggcattgcgacgcatcgcctgtcaaaaagacagcatcagtgtccgtttaccggatcacggcagggcagcttaccgctgcaaaggcggatcaaacggaggcgtttttccgccagcagcatgtaaagacggcaagaacagcggcgggaaaaacagcagaaaacgaatatcagctgctttctcagcagacggcagaccagtcgaagataaaaaaaggattgaatctgctggcgggatataaactgactgccatttcaaaaacgatatccaagcagacggacacaacgtaccaagtcacaaccgaatcactgcttgatacggcaaagatcaatcaatcgctggattttttcaaagggaaaaaagtatccgcctccgcacagaaaacaggtgaagcggcgtatacacaattcagaattgaaacggcaccgctgcttaagaaggaagacattgaccgcgtgactgcttttttcaagcaaaacaaagcggccggcactgtgaaggagacggggaaaaccggctctgcacaatacgtcatcaaaaccgaaaaattcagcagtaaaaccgttttaaataaaagcatgagctttttcagcgccaaacaattacaggccggctatacgagtgaaagccatccggtttatgaactccgcattcgcaatcaattcacgggagcgcagtcagcggacgccgcctcccaaaagctgaaaaagctgtacggatggacgatggctattctgaaaataaaaaacggaccgcaaatcatgaacaccaattacaacatctcgctggcagatatggtcaaaaaacaaatgacagtcagcccgcagactgatgccgcggcttatgcatcgcttacgtacatcaatacggcctccggaacggtcacagccgacgtcctgaacgtccggtcaaccccggaagtcagctcaggcaatattatcgggcagttgaaaaaaggcgataaagtcagcatcacaggccagacaaacggctgggccaaactcagcatgggctggagaaacgccagcagtgacgaagtcgggcagtacgtcaatccggctcacttcgcacaagacagcaagtattactttcaatttctgaagctctctcagacagccggactgaacgcatcggaactgaatcaaaaagtgctggtcaataaaggaatactgacagggaaaggccaggcctttattacagccgccggcaaatacagcattaatgaagtgtatttgatttcgcatgctttgcttgaaacgggcaatggcacgtcagagcttgcgaacggcattatgtataatggtaaaaaggtttacaacatgtacggcatcggggcttatgacagcaacccgaattactacggcgcacaatacgcgtataagcaaggctggtttactccggaagccgcgattatcggcggagcccaatttatcggtgcgtcttatattcacaatccttcatacgagcaggatacgctgtataaaatgagatggtctccagccgcggctcatcagtatgcgacagacatcggctgggcgtataagcaggtaaaccgcatgtacagcttatactcactgctggatgactatacgctttactatgatgttcccgtgtatatgaaagtataaaaaaagggctgaagtgtatgcttcagccctttcttcatgcaaaaaacacccgcctcagattcaggcaggtgcttcagcacaatttttcatttttgtttccgcaaatttcaataacgcttcactcgaattcccatctgaatacatattccatttgtccgagaaccgcttcatttcttctgcatcaaatggctttttcgtcatttcctccaaaagagcttcactgtcatgacaagcctttccgggaatgacggaagtataattgtcgattaaaccgcgttttcgatcatattcctccagatcatacgtgaaaaagaaaatcggtttatttaagagcgcgaattcaaaaggcacggaagagtaatccgtaattaaaatatcagccgctttcaagagatcatgaagacgcatgtcagacacgttcttgatcaattcgctttcaaacgaagccgaaatatgatgcaaaacggcaggatgaagctttacaagcagcatatactctccgtttaacgcgtttgtgagctgttcttcggtgaatggcagccgaaaggactgcatatcataatccctgaatgtcggtgcgtacaggatgatttttttcggccatttgtgcttcggttcgggcttgtgttcttcataatagacgtcagtcagggggacacccgtttttaacagctggccgtcccgtatgccgaacgactttttaaaaacgtcagccatcgcgtctgaaccgacggtgacaaagtcaaacgagcggtacacttttttaaaacggctgatgtctgatgccggacggttttgattcgtcacatcctcaaggccgaactttttcaaagagccgttcgcatgccacacttgaatacatgtcgtttgcggccggcggtttaagacgcttgtcatgaggaaatagttatccgttatcaccgctttgctcttaaaaaggatcaaaaccgccttcaaaagatgcagcggatgtttttcgttcagataaaaagagccgagtccttccagctcttttttcagactgacggcgtgtctcgtatacaaaaccgtcacttcataagaaagcgattcagcgtgcgctttgtaagaacggatgagagcctgtgcattctcttcaaaagataccagcagggtcagatggttcttgggctttacaggcttgaacaaaacgcccagaacagacagatatatagaataaaaagcggcgaataaagatcgcaagttcatagattaccaatctcttttgctgttttatttgtttaaagctgtttcgtttgatcttctgcctgctcggaatacaggcttttatttgatttattatttctcaaaacggtaaaagcatacttcggaatgttcagcatccttttccatctccacggattcgtcaccagtctgtacagccattccagattcgttttgatcatccattcaggggcgcgtttcaccgttccgctgaacacatcaaagcttccgcccaaaccgatcgatacagcctgagggaaaagatgtttgtattcataaataaattgttcctgatggggatatcctaaggcgacaaacacgagatcgggtttcgcccgggaaatctgtttggcgacgaagcgtttatccgcttcataaccgttgctggctccgacaacctcaatattcggatactctttgccgatccggttcaaaacggcgtcaagcacgtcttgcttagctccgtataaaaatatttttttagactgccggtttgcgagaccgagcagcgacagaaatacatcgaatcccgcaattcttgatttcagcgggtgctgcgtcaaacgtgacattaacacgacgccgataccatccggcaggacgaaatccgcggaagaaatgacttgatgataacctttgtctttcgccgcagcgtatccgatctcagggttgaccgtcgcaatgacggctccttgcttttgtgcgatataataagtgtctaaatatgaaataaactcctgtaaatttccattaacataagaaaggttgtgcaccatttcagtctgcatctgccgtcctcctttttgtacgggattttctttcattttttcgtgacttaagctaagctttattttaacataataccttcagataaacttaacaatagttttacaaaaatataaataagataacaatttctttaatcaaccgcgcaaaaaccctgctaaactcctattgcaataacatttgttaataagtggaatttaacttcgttttacattagcttaaccttttcagggctatgtgatataatgaggttccatgagtacgaaattggcactttagtgattaaggatacagctgcgcagcatttcagggcagttgcttgttatacgtatgatgatagaaaggagcttttgtttcatgaagaaggtcattacttacggaacgtttgatttactgcattggggtcatattaaactgcttgagcgcgcaaagcagcttggagattacctagttgttgccatctcaacagacgagttcaacctgcaaaaacaaaaaaaggcctaccacagctatgaacacagaaagctgattctggaaacgatccgttatgtcgacgaagtcattccggaaaacagctgggatcaaaaagtacgtgacgtagcggatcacaacatcgacgtgttcgtaatgggagacgattgggaaggcaaattcgatttccttaaagatcaatgcgaagtcatctatctccctagaaccgaaggcatttccaccacacagattaaaaaagaaattgccggggtgtaattgaaacattcggatatacagatgataaagaagtactccctccggatagggagtacttcttgtaatataaggttattttcgctatatttgttatgcgcttttgaaaaaaagctagacaataagaggagaatttaaagatgaatcttagtaacttttttaagttgaataaaaaagagtccaagccgtccatagaagaacgcgaatataccattttaaacaaagaagcattggcggaagagaagaaggtagcggtagtcgttcctgtttataatgcagaagaatatgtaaggaaaacagttgattctgtgatccttcaaaacatcggctttcagcatatttctttaattctggtagatgattgctctaccgatgattccagaaacatcctgactgagtacgccgaattgtatgaaaatattacagttgtctttttgaaagacaacacgggaactccggcttatccgagaaacttgggaattgagctggcaaatgcgaagtacattacatttttggatgcggatgattggtttgcgccgaacggggttaaaatcttattcgacatgcttgaaagagatcatgtaaattatgcggtcggaaaaacgatcgaaatgcaggtgaacggtcaaaaaacgatcgggaaacatgagtcttcgctgaacagagcgaaggtatcgcctttttcaatccggcatattttctatcatctgggcccgcgggcaagaatgatgaacttacaatttctaaaagataacgatatcagatatccggaaatgaaatttgctgaagataagcaattttttatggatgttcttttggcgtgcggagatatttcaacgtcaaccgaaccggtctattatctgaacagaatggacaataatgagtcgctgacaaagcagaccaatataatggaaaaaaccgacacgaacatagccgtaatgaagtatattctgaacaaaaaattagatactgaaaaagagaagatggcgatgaaccgcctgattgaattcgattccattacgcggcttttcgatcggatgcacttcctgaaaagcgaaaacaaagaagcctactacaataaattcaatgaaattctgaatgtgttaaagaagacgaaatacgatatttccgagacattttttcatccgattcataaaacagcctaccgtctgctgactcaaaaacggtatgatgaggtcgaaaagctgttccgctggtccaaaaaagagcccgataaaaacatcgtgacgaaagacggactggcttatttagaaagcccgctgacggatgaagaaaataaactggtcgaacttcgcatgcacggagaaacggaaagcgcggtgttcgccgatcataaattcaccgttacgttccgcttgttcggacaggacagaaataatgcccaatatattcagtttcagcacagagataacatgaaagtacaccaccagtttccggttcagtcactgggagacgggcggtacgtccttgaaatcccgttaagtgacattgaaaaagtcggacttggcggttatattatgtatgtcatttataacgattatgaacgtgtcatgttaaacagagaagacggtgaaaaggtgacggcagaagcgaacggactgcaatatcaattctaccggacggtgaaggagaacctttcactgaaagtaacaaaatgatgattgtgattggatatgtttaattgaaacagaggagtagacttattttatgggtatagaaaatcctgtcagatacaagttaaaacatcttaacataaaggaagagacattcagcattacgatatcctgtgaaaatgtcactgcaggggaagagccttctcttcagattataaatcgtaaaacaaaagcggaactttccgtccctctgaaacggttggccggagagggcggagagtaccatgctgtcatgagcacggatctgctttctgaccatacggacggcaaaggatgtctggatttctatgtctcctttatcaatgatgacagtgatatcagtaaaaaacggttaaaatccagccttgaacctattgaactgtcttcttataaagatgaggctcatcatatgtactttttcccttacacgacgaagaaagggaatttctccttaaagctgctgcagaaaaagttcgtcacgcggattgatgaaatggagctcgaatctgacggcagcttacatctgaaaggttttgcattccggctgaatgcggcagaaaccttaaagataaaagaaaaaaacctgattctgaaaatgaaaaaaggaaaagaagaggagcctctcattctgaagtatccgcttcacgacgtgccgagacacgaccttgatgaatatgttcaggacacaacgatgcttgacacgataggctttgatacaaaaattgatttgaatgctgtttataaagaattgaatcagcagctcatctttcaattccatattcaattcatttttgaagatgccgggacaggtgaagaggttatcaccaacagcaaaccgttaaaggttctgaaatctgaacatgtaaaccctaaccaattcacggttctgaaaacggaaaaagggcctgccagatttcacgttttcacgaaaaagaaaacgaaaaatctccacctgagaatgaacgattacagcttcagcacccgcgtggagtattttgtgaaaggtaagctgaaacggggcgcttcctttgtacgcaagagaaagaataagctgaaaaagttcattgagaaaagaatacagaacacttacaaagcaggattcagatttgcaggaaaactgcctgtcaaacagaaacttgtcatgtttgaaagctttgccggaaaacagtacagctgcaacccgcgggcgatttatgaatacatgagcaaagagatgccggaataccgtctctgctggagtgtaaaccccgcttactcacagacatttaaagataaagggattccttatatcgaacgcttcacgttcaaatggctgtttgccatggcaagagccgagtactgggttgtcaacagccgtatgccgctgtggattccgaaacctgagcatacgacatatgtccagacatggcacggcacgcctttaaagcgccttgccgtagatatggatgaagtgcatatgcccggaacaaacactgaaaaatacaagcgcaactttacgacagaggcttcaaagtgggattacctgatttcaccgaacgcatattcaaccgaaatattcgcccgggcgtttcagtttaataaaaccatgattgaatcgggatatccgcggaatgacttccttcagacggataacagcccttctgtcattaaagcgctgaaagaaaaaatgaatcttccgcaagataaaaaagtgattatctacgcaccgacatggcgggatgaccaattttataagaagggaaaatacaagtttgaccttgatttagaccttcaccaattgagagaagcgatcggcgaccgttatgtcattattttacggatgcattatctcgtggcggaaaactttgatctcggaccgtatgaaggatttgcgtatgatttctccagctacgaagatatccgtgagctgtatatggtctctgatttactcataacggactattcctctgtcttttttgactatgcgaatctgaaaagaccgatgctgttttatgtgcctgatatcgaaacgtaccgggataaactcagagggttttactttgactttgaaaaagaagcgcccggcccgcttgtcaaagaaacaggtgacgttatcaaatgggtcaatgaaacggaatcagatgattataagcttccggattcgttcgggcctttttacgagaagttctgttatttagaaaccggagaatcgtctgaaaaagccgtaaaagtgattttcggggacaagtaaataagtgcaaaaaagcataatttaaccatgttaattatgcttttttgcttaagtgacggcatgttgcgctcatgggactcaggcttgttatgaagtgaaaaatacatcgtaatctgttacaattatgagcggtgcttttgtaagtcaaagctattacctaaaacttacgactaaggaagattagaatgaatgcattggtaaaaattctgaaagagcaattcaactcatttccgctgattatgcggcttgcagtgtacgaaacgaaatcaaagtatcaagtgaactatttgggtatattgtggcagtttctcaaccctatgattcaaatgctggcttactggttcgtatttggcctcgggattcgcggcggacatgatatggtgcttggaaatggagacagcgtaccgttcatcgtctggatgctggccggcttaattccttggttctttatcagtccgacgatactggatgcatctaacagcgtttttaaacggataaatttagtgtcgaaaatgaactttccgatcagttcactgccttctgtagtgatagcatcgaatttattcagttactttgtgatgatggcgatttatattattgtgctgctgagcaacggactgtttccgacgcttcactggctgcaatatatttattacttgttttgcatgatcagttttatgtttgctttcggcctgtttaattcaaccatcagcgtattaatcagggactatcagtttttgcttcaagccgtcacaaggcttctcttttttcttctgccgattttctgggacattgcggagaaatttggaaacagacctgaagttttgaccatcttgaagttaaaccctcttttctatattatcgagggcttcagagacagctttatggaagggcagtggtttttccacgatgtgaaatacacgctgtatttctggttcgtcacactgctgctgttaacagtcggttcacttcttcatatgaaattcagagataagtttgttgactttctttaatatagtaaggagattatacgatgaaactaaaagtttcgttcagaaatgtttcaaaacagtattttctatataaaaaacagtctgacaaaattaaaggattgtttttcccaaacagaaatcaaaaaggttttttcgctgtccgaaatgtttcttttgacgtctatgaaggggaaacgatcggattcgtaggtatcaacggctcgggaaaatcaacgatgtccaatctgcttgcaaagatcattccgccgacaagcggtgagattgatatgaacgggcagccgtctttaatcgcgatttctgccggattaaacaatcaattaagcggcaaggacaacatccgtttaaagtgcttgatgatgggtctcaacaatcggcagatagacgagctttatgaaaaaatcgttgaattcgcggatatcggcgactttatagatcagcctgttaaaagctattcaagcggtatgaaatcccgtctcggttttgccatatcggcgcatatggaccctgacatccttattattgatgaggcgctctcagtaggggaccagactttctatcagaaatgtgtggaccgcattacggaatttaaagaacgcggcaaaacgatctttttcgtcagtcattccatcggacagattgagaaaatgtgtgaccgggtggcttggatgcattacggcgaaatgcgtatgttcgacgaaacgaaagccgttgtaaaagaatataaagcttttgtggattggttcaacaagctttcaaagaaagaaaaaaagaaatatcaaaacgagcagattgaaggcagaacgcgggcagccgaggaacagaaaatcactcaggcccagcaaaagaaagcgaagcctaaattcattgccaatacgatacagattacgctgcttgcattgctggctgtcggcgcaggcgcttcgatgttttcagacaagcctctgcgtgcgatcacatctttcggtgacgtcaaacagagcgatgccggcctttatgagtctgtgaataaacctgctttggtaaaagctgaaaaggcggacctttacactgaaaaagatataaaaggaaaagcctccgcaagtgtaagtttcggtacgaaggtgcagatagaagccgagaataaccaggcggctaaagtgaaattaaacgataaagagtactttatgaaaaagactgatctatataaagtgaacgctttaaaaaagacggatgttcagctgaatgatttcagcggcagtttatcaagccaaacagcagaagagtttctctcatatctcaataaaagccgggacgatgtgcagcgtaaattgaaaaatccagctgcgggacaaacggctgacggacggaacgtattaaaagcatccgatgcaaaaacggatgtagtgattgacaatgatacagtctccgaagtggtttttcatttatcgcgtcctgcagacatctcagctttaagtgaaaaaggcggcagcaaaatcaatcagaatttgctcatgcttaaaaaccaggaatatactttttctgtgaacaatgctgataagacactgacggtaacgtctaaaaagtaaagatcacataaaaaaagctgccggattcggcagctttttctattcgtcagcttcttctttttcaagaagatccttcatgaacggaattaatttatggcggatatcctgatcctgtaaggcaaattcaagcgtcgtctcgataaatcctagtttttcaccgacatcgtaacgttttccttcgaaatcataagcgaagacacgctgaatgtcattgagcttttggatggcgtccgttaattgaatttctccccctgcaccgacttcctgctgttcaaggtacatgaaaatttcaggagtgaaaacgtatcttcctaaaatagccaagttggaaggagctgtgcccggttcaggcttctctacaaaatttttgacctggtaacggcggccttcatttgttaacggatcgataattccgtagcggtgtgtgtcgctttcaggaacttgctgaacaccgatgatggaagacaatgttttttcgtattcatccatcagctgacgaagtcccggtttttcagcctggacaatatcatcgccgagaagaacggcgaaaggttcatcgccgatgaagttgcgtgcgcaccaaacggcatgaccgagtccttttggctctttttggcgaatatagtggatatccgcaatatttgacgattttttcactttttgaagcagttcgattttccctttttcttctaaattgcgttccagttcaggggcattgtcgaaatggtcttctattgctctttttccttttccggttacgataataatatcttcgatgccggattcgacagcttcttcgataatatactgaattgtcggcttatcaacgattggaagcatttctttaggcattgcttttgtggccggcaaaaaacgagtgcctaaacctgctgccggaataatggctttgcgtactttcttcactgaataacaccatccttgtttctgcaaaatctttttttcagaactataacctagtctttttccactttaccacaattgattaaaattcacaccttttaatccgctttcaaagagtcttgtaacggtttttgctttgtttgccattaagctttacaatattaagaaacggcataaatatgttaacatgaagggatatccgacatataaaacgaggtgcagacaaaccgttgaaaaaactaaaagtaatgaccgtattcggtacaagacctgaagcaattaaaatggctccgctcgtattagagcttgaaaaatatcaggaaattgattcgctggtgactgtaaccgcacagcacagacagatgctggatcaagtgcttgaagcattcagcatcacgcctgattttgatttgaatattatgaaagagcgtcaaacgctttcagaaattacatctcatgctttgctgaaactggacaagctgtttcaagaagtaaaaccagatatcgttttggtccacggagatacgacgacaacgttcgccggaagccttgccgccttttatcatcaaatcgccgtcggccatgtggaagccggtctgcgtacgcaaaataaatactctcctttccctgaagaaatcaaccggcagatgacgggcgtgatcgctgatgtgaattttgcgccgacaagccaggcagaacagaatctgcttgctgaaaataaaaagccggattctatatttatcacgggaaatacggcgatagacgcgcttcaaacgacagtgcgggaagactattctcatccgatttttgacaagctggaaggaagcaggatgattcttttgacagcgcacagacgtgaaaatttaggcaggccgatggaacagatgtttaaggccgtcagaagaatcgttgaagagtttgaggacgtacaagtcgtttatcccgttcatttgaatcccgcagttcgtgaggccgcagaagcccattttgctgattcggacagggtgcatttaatagaacctctggaggtcgtggatttccataacttcgctgcgaaagcaaatttcattttgaccgactcaggcggggttcaggaggaagcgccttctctcggaaagccggtcttggtgcttcgggacacaaccgagcgccccgaaggagtgaaagccgggacattgaagctggcgggtacagatgaagaaacggtgtatcagctgacaaaacagctcttaaccgatcaggccgagtatgaacggatgtcaaaggcgtcaaacccttatggtgacggatcggcctcaaaacggattgcggaagaactgctttatcggtacggctatagaaaaacccgtccgcagccttttacagaataaaaaaactctgcatcatatgcagagttttttattatttcaggctttcttttaattcttttttgactgaagcgaggcttgcttcatctaatttgtaataatagatattgttgattctcgttcccgttcccttcagttcatgctgagtgactttgctgcgggcatttttatagtcagtcataaccgtccacatatcatcgaatgacatgtttgttttcatattgttttcaatgaccttaaacatatctccgaatttcgtgacagacgagatgtttgcccccttagaaataatcccttcaatcacttggcgctgccgctgctgtctgccgaaatcccctcgggggtcttcttttctcatgcgggtgtaggcaagtgcttcttcgccgttcaggctgatgttccccgttccgaaagaatgcccgtcgtagttgaaggcgaacgtgctgttcaccgtaatcccgccgagtgtatccacggtatctttgaagctctccatgtttactttcacaaaataatctaccggcacgtcgagcaggtcctcgacggtatccgcggccatttgggttccgccgaaggcataggagtggttgattttatccatcgtacctttgccggagattttcgtatacgtatcgcgcgggatgctgaccatttccgttgtattcgttttaggattgacggtcatataaatcatcgtgtccgcgcgccctttgtcatttttccgctcatcgactcccatgattaaaacagaaatcggatccttctttccgagatctatatccgtgtcacgtttgtccgatttttttaagtcttcctgaatgcttgccaccgttgaagccgctttgtgccacaagtagtagacgtagcctcctgatgataaaactaacagcccgatgattgttacgattgtcagaagaacctttttcttctttctttttcgttcagctctcatttgtcatcaccttttctattaactttcatgatgcaatttactaatctttataaacccagtcatatttttacttataaccatgtaatagacgaaattcttaaaaaaaaggttacaaaaagaccttaaaattaccttaaaaaaaagttagtataagacgatacataaagatgaggtgaaaaaaatgaaaaaaactattgcagcttcgttcttaatactgcttttttctgttgtattggcagcgtgcggaacggcggaacaatcaaagaagggaagcggttcttcggagaaccaggctcaaaaagaaacggcatattatatcggtatggcggatacgcacacaattgaagtaaaagtggatgatcagcccgtcagctttgaattttctgatgacttctctgatgttctgaataaattcagcgaaaatgacaaagtcagcattacttatttcacaaatgataaaggccaaaaagagatcaaggaaatcgagaaagcaaaataatacaccatgatcagcaaaaggcgggataaaaattgaagaaaacaatatgggctgtctgtttttctgtgatattcagcctggctttattaccggaaagcacttttgcggccagttctgatatctcagtaaaactgacgaattatattggtaataaatcgactctgaatatcgaaccttcaggaacttataaactgacgggaagcgatgtgtcctccgttgtcagattgggaggcgcgtccaaatatgatacggctaacgccgcgacatctaagtattggaaaaacccgtccaacgtagtcgtcgtgaatacggacgcttattttgcggacacgctttccgtcattcctttagcgaataaactgaaagcgcctgttctgctgactgaagcgaaaaaactgagcagcagcacagaagcgcaaatcaagaaattcaatccggataatattttaatcatcggcgggacgaacagtatttcgtcagccgcggaaaagacattgaagaaatacggccgtacgaaacggatcagcggaaaaaacagatatgatctgtccaaaaatattgcggccgaaatgggcagctatgaccaggcggtcgtagtaacgggggatgtatatacggatgcgctggcaatcgcgccatatgccgcgcaaaacggctatccgattcttctgacgaaaaaagactcccttccgagctacaatctgcctaaaaaagtgatcatcatgggaggcacttcaagcgtcagcaaagatgtggagaatcaaattaaaaagaaggcctcggtcaccaaacgaattaccggatcaaacagatatcaaatatcagcaaacgcagtcacttcgcttggcatggatgcaagcaaaacggtggctgccaacgggactaaattagcggacatcgtagtcggatcaaatattgccgccgcaaatcacatgccgcttgtatacatcaaaaaaagcgaaacacccgccgacgaggccggcctttttaaaacgaaaggcacctattcttatacattaataggcagcgcgaattcaattgccgattcagttaaggctgcttacgcaaaagagttttatctcgtaaacggaaagacgtaccgtattgaaacgtccggcggcaaattaggcgttgcaggcattaacagcggaaaaacgtctttcaaggcggttcctgaaaaatattcaacagcaaacacaatcagcattgacgggaagccatatctggggaatatgagtttcactgctgaatccggcaaatatgtaagacctgttaatgaaaacattccttttgaggattatctgaaaggtgtcctgccgaatgaaatgccgggaagctggccgacagaagcgctgaaagcccaggctgttgccgcccgcacctactctatcggcaagatgggacaaacagtcgcggatacaacggcctttcaggtttacgggggatacagctggtatccaaacgccaccgcagccgttaacggaacaaaagggaaagtgctcacttattccggcagattgatagatgccacttactcatcaagcaatggcggttacatggaagccggcgatgaagtgtggggatcgaaagtgccgtatttagtagccaaaaaggacacaaaagatcccgaaatcagctggtctttaacattgcagaagcagcagctgccagcgggtctggatatgaaaaatcccgcatcctggtggtctaaaacaaacgaagcaaatgctgcgcagctcaacggaataaaaaattggctgatgaaaaataaagaaaccaatgcaagttccataaaaattgcaagtatctctgatctctcgctcaccggaaaaacaaaaggccagcgcgcggaagacgccgcggtgaaggtcacgtaccatgtgaatgacaagtcgaagggctatgtcatgaacaagactgcatctgttgaggtgaaagcgtctgaacttaggacgatgatcggagcttcatcttttaaaagcacatacgccagtgcgtccggtaattcttcgcaaatcacgatatcaggaaagggatacggtcacggcgtaggaatgagtcaatacggagcaaaagaaagagcggaggccggagagccgtatacttctattcttgcgttctattatcctaatacagcacttacaaactactaaacttctgtggaggagatcggattgaaattcatcataaaatgtctccccgtctttattctcggggtcattctatttgtcccttccgctttggctgacaacacggttaaaaggatcggcggaagcacccggtatgatacggctgtactggcggcaaaacaatcatggggtgaagcgaaaacggtaattatcaccggcggaacttcatatgccgatgcaattgccgctgcgccgcttgcatatcaaaaaaatgcgccgctgctgtttacaaataaagatcagctgtctgccggcacaaaaaagggattaattgatttaaaaacgaaaaatgtgattatcgtaggcggcacacctgccgtttcgaaaaataccgcaaatcaaattgctaaattaggcatcagtgtcaaacggttatcagggagcacgagatatgccacagccgcaaaagtggcgggtgaaatgacaagatcttctacagcccttgtggtcaacgggtttgttgatgcggatggaatggctgcgatttcttatgcgtccgctaaaaaatatccgattttattcactaatgattcaacgttaaatggttctgcgtccaatgcgatcaaaagcttagggattaaaaacacgattgtcatcggcgggacaagcagcatcagcagctcactttataataagctgccgaacccttcgagaatcagcggcaaaaaccgctataacctgtctgtgaatcttgcaaaaaagacaggcttaagcacaggctatacgtttgttaccaatggctttaaagaggcggataccatcgtcggaggcgtgctgagcgccaaacagggaagagttcacctgctgacgaatggagacagtctgtcaaaagacgtccggacgtatatcggaagtaaaaacatcaccagcttcaccgtcataggaagtgcttcatctttaagcaacaatgccgcgtcgcagcttaaaaatcccgttgtcggcaaaacggtctttattgatccgggacacggctatcaggattcaggtgcaaccggaaacggcttgcttgagaaaaatgtaaaccttgatatcgctacgcgtcttaacaatcaattatacggcgcgggcgcgcttactgtaatgtcaagaaagggcgacacctttgattcgcttgaggagagagtgaacaaaggggcgaaggcgaacgccgatattttcatcagcgtccatgcaaatgcgaatgataacagcagtgcaaacggtacggagacgtattatgataaaacctaccaatcggcaaacagtctgaggcttgcccaaaatattcagccgagaatggtttctgctctcggcacgcgtgaccgcagtgtgaaaactgccggattttacgtcattaagtattctaaaatgccgagtgtcttgttagaaaccggttttgtcacaagcccgattgatgccaatattctaaaacaatcaacgaaaaaggacagactcgcggcggggatcacccaaggcgtttcctcctatttcagataatttttttcatggaaacagaccggttcataccggtctgtttttttattttttcattatgctttgtctcaaatatggatatgaatagatttacaataaaaaaacaataatcgaaacattctaataaacattaacgtttcctttacttccaattaacatccatctgctaaactcacggcataggtcatcaaacatcccaacaaatcgtgaggtgtgtgtcagtgggagcagagaaaagcatgaatgtaaataataactatgcagtgcggcaggggacttccgctgccgttacggaaagaacggcccgttatttggcttttaagcgattcatggacattgtgtttgcgcttgcggggcttttggcggcgctcccggtgatgggcctgttctccatactgattcgtttggagtcgcccggcccggctttttacaagcaggagcgggtaggcaaagacgggaagccgttttatttgtataagctccgctctatgaaaatagatgctgaaaaatcgggggcggtctgggcgctgaaaaaggatccccgcgtgacaaaggtcggcgcttttatcagaaggacccgtattgatgagctgccgcagctggtaaatgtgcttcggggagaaatgagcctgatcggcccgcgtcccgagcgtcccgtgtttacggaacagtttcaggctgagattccggggtttacggagcggctggccgttaagccgggattaagcggctgggcgcaggtcaacgggggatatgacatgacaccgagggaaaaactgatgtttgacttatattatatccgcaacctgaccttttcattggaactgaagattatgctcaaaacgtgcaaagtgatctggaccggtgacggggcgcgataaaaattctggtcagcagacaaaaaagtagggaaaacgatgcctagtattacaaatcaaattttgagcggcgccaaatggacaagtatttcgacagcgtgtattacggtcattcaaatcgtccaattcgccctgctcgggcgggtcatgtcactggctgaattcggccttgtcggcatgatcacaacggtagtggtgtttgcccaaattgcgcttgatatgggttttggcgccgcgctcattcaaaaagatcatgtgactgataaacagatgtcttccttgtactggctgaatatcataacggggcttgcgctgtttgcgctgctgttcttcagcagtccgctcattgccgatttttatcggcgggaggagcttgtctatttaatccgcgtgctggccgtcatgtttttaatcgcgccgatcggtcagcaatatcaatatatgctgcaaaaagcgctggcatttaacacgctaagcaagattgaaatcttttcaaatgtgctgtccttcgtttacttggcggctgcggttttttatacggacccgattctcgcctatgtgatttcccaggtgctgctgcaatcgtcaaaaggtattctgtactgggtgtcctgcagaaaaacatggagaccggtgttcgtttttgatctgaagggaatgaaaggcttcttttctttcggagcctttcagctgtcttcccggcttgtgaaccggctcggggcgaatattgatatgattctgatcggcagttttatcggcgccgaggcgctcggcatttacaatctggcctaccagattgtcacgcttccggtattaaaaatcaatccgatcattacgagagtcgcgtttcccgtctttgcgaaaaacaagcatgaaaacagcgtgatcagagaaggttttctcaatatgaccaaaatactcgcgctgatatcctttccgcttttgctcggtttggtttcagtatcggatgcattcgtggcttcggttttcggagaaaaatggctggcggctgtcccggttttaaacgttctcgccatcgtcgggattttaagggttctgatgaatccgaacggatctgtgctgctggcaaaagggcgggccgatctggcattttattgggacgccggggtgatgctgctgtatggtgcatctttgtacgccgccgtgctgtccggaaatctcttgacggtagcctggacgtacgctttcatcagcatcctgaatttcctgatcgggcgctggctgctggcatatgtcattaagctgcggctgtcggcttacttcaaagccgtggccaaaccgtttctgcttacggcggcaatgggtgtcatcgcctttacagccagcttcgggacggagcggatcagccttgatgtcaagctgcggctggcgatctccgtatcctgcggagcgttgtgttatttgttcctgttaggaaaagcttatccgcatatgaaaagtaaattaagaaaaggacgtttgctatgaaggtattgtggatgacaagtgtatatccgagcagtgagaagccgggagaaggcgtttttcatgagacgcaggcccaagaactgagaaagcttggcgcggagatgactgtcatttgtccccggccgaaactcgccgcgccattccgggtgctgaaaaagacgtatcggcaaaaggatataaggccggcgcatgaatggcggaaaggcgtgtccgtccaccggccgttttatcaggcggttcccgggcagctgaaatgggcgcagccgcataaaagaatggcgtcatcggttctttccgaaattaaaaatcatggcctgaagcccgatctgattcacgcgcatttcgccatgccgtcaggcggagcggccgccattgtgtcaaaggctttaggcatcccgtatgtgctgaccttgcatggcagtgatgtcaatgtctatccgcattacagcaaaagcgctcatcgcgcatttacatttgcggtgcgggaagcagccgatatttacgctgtgagcggcagtctgcgggaacaaatgaaaaagctcatcgaagcggagtgcagcgtgcttccgatcggcatcacgcttgacgccttccgaaaaaggaacgagacgaaagaagccgtcagaaaacggctcggccttcctccggataaaaaactgatcgtgttcatcggcaggcttgtcaaagagaaaggtgttttcgacttatcaaaagccgttcagtcattggatgaaagatatgaagctgtctttgtcggtgacggtccagccgcatcttcattgcgtgaagccgctcatatcgtcacggggcaagtgccgaacgacaaggtacaggactatctgctggcctcggatgtaatggcgctgccgtcctacagcgaaggcatgccgactgtggtcattgaggcgctcgctctgaaggtgccggtgatctgtaccgatgtcggaggattggcttctttatttgggaaatatagaggtttgctgatcaagccgggttcacctggcacgctggcagaatccattctgcaatatgacgaaggagaggcttggacgccgcaaacagccgaggaactttatcaaaccgtccgcacgtattttgacgcaagccaaaacgcgaaagcgctgaaagagaaataccggtccgtcatgaaccggtccgggcaagaggagaacctttcgaaagagggatgaagctgtgaaaaaaatcgctgtattaggaacagggtatgtaggtcttgtatctggaacttgttttgcggaaatcggccatcatgtgacttgctgtgacatcaatgaagcgaaaatcagaagcttgcaaaacggagtcatcccgatatatgaaccggggcttgaggaattagccgaaaaaaatgtcagtgacgggcggttatcctttacggccgatattgagccggctgtgaaagccgctgatatcatctatatcgccgtcggtacgccgatgtcaaagacgggtgaagccgatctgacctacattaaggcagcggcgcaaacaatcggagaacagctgaacggatacaaaatcattgtcaccaaaagcactgttccggtcgggacgggaaagctcgtttaccaaatcgtcagcgaagcgtcaaagggaacatatccgtttgatgtcgcgtcaaatcctgaattcctccgcgaaggttcggcggtgcgggatacgatgcagatggagcgggcggttatcggcgccacaagcgaacatgccgcttcggtcattgaagagcttcataagccgttccgtacgaagatcgtaaagaccaatcttgaaagcgcggaaatgattaagtatgccgcaaatgcttttttagccgccaaaatatcttttattaacgatatcgccaatatttgcgaacgtgtcggggcggacatttctcacgtgtcagaaggcgtcggtcttgacagccggatcgggaataaatttctgcaggcgggcatcggattcggcggatcctgctttccgaaggatacaatggctttattgcatatcgcaaacgccgccggctatccgtttgaaatgatggaagccgtcattgaaaccaatcagaagcaaagggtccgtattacggaaaaattgaaccgcgccatcggtcccttaaaagggaaaaccgtggccgtactggggctggcctttaaaccgcatacaaatgacgtccgctccgccccggctcttgatatcatcacaagtcttaaagagcagggcgctcacgtgaaagcgtatgatccgatcgcgattcccgaagcggcagcgatattaggagaaggcggcattgaatatcacgcagagatgtacagtgccatcaaaaacgcggacgcatgcctgattacaacagattggccggaagtcaaggagatggatcttcagagagtgaagcggctgctcaaacagccggtcatcattgacggcagaaatatgtttccgttggagtatatgagggtttcaggattcacttatcattccgtcggacgtccggcggttcatgccgatcggcaaataaaagaactggcaagatagaaaaagatttgtcttcaggctctcggcagcccggctcggctgccggttttggaaaggggtttgccatgtgagtatcaaacgttcagcggcacatgttcttgtgctgcttgccgctgtcattacaggaggattcatcatgctggaggcggtcagggcggatgccggcctcggaaaaatcaccgtgctgctgcttgccgccatgatcggtattgccggacttgctttgctatccgcctttacaacaaacggtcagatgtttatggggctcatttatatactgatcgcgtgtacatttttaaaccaggccttctttgcggttcatctcggatttttcagcttatttatataccggctgttattaatcggagcgggcgccctacacatcgccggcatcctgacaaaccgtcatcatattgacagatggaatcgggtgaatgtaaaaggggttctgatgtttttcgccttatggtttacatacggtctcctatcgttattgtgggcaaaatccgtgacgtacgggattaaatatttagctttaataggaatgggcatgtttttgatttatcttattgtcatgttcattcagcgctttgatcagctgatggttttttacggcatatggcttgtgatgaccatttttgtgatggcgatcggcttttacaaccattttacacacaaccatctgccgagctccacgctttataacggcccgcagtacaaacagcattatccgacgtccgttttctttaatcaaaatgatttcgcgacgtttttgtgcatcagtttctttctgtatgcggcggcggtgaaaaatatgaaaaacggctatgtgaaggccgtcagcctgctcttagcgatctgcgctttgtatttaatcattttgaccggttcgcgcgcgagtctgctgggcatatgcgcgggggcggctgtatacgtcttcatcctgctgccttctctgttgaaaaaattcgcgctgtacgctgcgggagcgggtgctgcgctgtttgcggttttatttgcgggccgtatcaccaatgccgtcttgaatctgttttcagctccgcaggcgatgccgggacagcagccgcttccttccaacctcgccagggcgaatcttttaaagaacgcctttcactatgtaattgattcctgggggtccggagtgggtgccggaaacgtctcttactatttaaaagcggagcccgtttatgatacgggcggcgtagttgaggtgcacaactggctcgtcgagattatggcgaacttcggcgtacttacgatgctcggttacctgacagtctatttgttccttttttggacactttataaatgtcatgaaagaaaatcggaaaatcagtcaagactgatcacagaaggacttatcacggcgatggccggttttttggtaagcagcatcagcccaagctccgtatcgaatttatttttccactgggtatttctctcgctcgtgatcgcggcggtcaatatattgaggcgtttacaaaaggagcctgccgtcacggcgtactatgaaaaacagggagatgcgagatgaaggatatgttgacaagaataacccggcgtatcaaaaagaatatcatttggatcattgcgctgcccgttgtgttaggggcggcgggatatgtattgccgtcaaaaatcagcggaaacagcagttttacatcagaagccgcgatcgccgcgggaaattatgatcatccgctttataacaatacaaaagaaatcccgctccttttgacgagcgatgcctttttaaagcaggctctgcctcataaaacagacgaagaaagagcggccgtgaaaagtaaactgactgtcgaaacacaatcagattcattgatcacggtcagctgcagcggccaaaacaaacaggaaaccgaatcggtgtttcaagccgtcataacaacttttctgaagaatgatcaggacctgtttgaaaaacgggcaaaagtagtgcggcagagtattgctgcgcttgaaggagaaaccgtcagcgcggacgccaaagtggataaggaacgatttttatacgaattgaaaaatacgcagctgaacctgaaagcggccggcgtcatcaattcagagccgatgaatgaaacggctggtcaaggcatgccgccgaaaaagaaagcggttctgggcgttttaatcggcattgcagttgcctttatgttcattgtcattcctgagttttttagagagtccttgtaaaaatctgcgatggagatgtgaccatgacaaactggaaacctttcgtatctgtcattacaccgtcttataacgcaagtgaatatatcgaagacacgattcagtccgttttacaccaaagccacccgcattgggaaatgattatcgcggatgattgttcaacggacggaacgagagatattttacggcaatatgaacaaaaagatgagcggatccgcgtcgtttatttagataaaaacgggggagccgcagctgccagaaatacagcccttaaacatgccaagggccgttatgtcgcatttctggacagcgatgacagatggaaaaaggaaaagcttcaaaaacagcttgcgtttatggcagagcggtcctgcgctttttcatttacgggctacagcgtcatggagcaggacggaacgccgacggacaaaacgattcaagcccctgaaagcctgtcatatgatgaagctttaaaaaacacgattatcggatgtttaacggtcatgattgacagagagcagacggggcagattcaaatgcctgatatcagaacgcggcaggatttagcgacatggctttccctgctgaaaaggggatttacggcttacggcctgaatgagtgcctttcagaatacaggcttgtgcagaattcgatttcaagcaacaagtggaaagccgcaaaaaaaacgtggtttgtttatagagaaattgagcgcctgcattttatcaaggcttcgtggtgttttatgcaatatgcgaaaaacgcggtcttgaaaagactgtaggcgtcagaggagctgggtgatgaaggtggaaccgattattcacgtaatcgtcggagcggcggaatgggggcatgaccggctgagatacagacggcatcggctggctgaatttcttgcccggcaaaaagaaacgaaaagcgtcatttgggtatgcccgtccccgcgagccaatgatgatcagatggccgggatcgccgagggaatccggcagttcactgtaaaggatctcatgcagcaaaaagcattccgtttcggcaggtatacagacatgtgttacaggcataaactttcaccattgttgcacatgctgaaggaagaaggagaaggggcccgctgctgcttatggtacaccttccccggtttcccgcttctggcagatctgtttccttgggatgaagtgatttacgattgcagtgatctgtgggccgctccgatcagcggccgggccggtgtgctgtcaaatgtaagaagaaacatcattaaacaggcggaaatgagaatcattcagcgtgccgattccatcacctgcacatctgactgtctgcaccgggaggtcggaaaaaagctggagaacccgcaccagaaagtgttcaccattgaaaacggagtggaatatgacctgttttcacgggaaaataaacagccggatgaagacattttacggggacgaaacggaacggttctcggttttatcggcggaatcaaaccaaagctcgattttgcgcttatggcggaaacggcagatttgcggcctgactggacgattttattggtgggcccgaacacggctcaggacgatccggatttcgagtcgcttctggaacgcccgaatgtcatctggacgggacctgccgcgccgaatgaagtgccgtcctatatgcagcttgtcgacatcggcatcatgccgtataaaaattcaccttataatgacgcggtatttccgcttaagctttttgaatttttagccgccgggaaaccggttgtcggctgcaacctttcttctacgtcaaaaatcaaaaggccttacgtttatgaatacgttgaagggagcgaccccgcagatttcatcgcggcctgcgaagcgcttctggcagcggaccgccgcggatcatacgaggctttgcgccgtgaattggcccggggacgggattggaatgttttattcggccgaatgcttgaatgcacgggtatattggaaaatgcgcaatcccattaaaagggaaagcgcattttttgatttgcgtgtttctttttgatgatgcttgttataataactagtaagaattataatggaaggaacggttcaatatcagaaaagacttcatataattccaaaggagacttctttatgcttgacgaacgcatgtttcgcatagttgttgcgttttttgtctctctgctaacggttttaatcctaactcctatcgtaaaaaaaattgcgatcaaaataggtgcagttgaccagcccagcaaccgaaaagtacatgataaaataatgccccgtatgggcggcttggccatctttatcggcgtagcggcgggtgtgctcgcggccggcatatataatgaaacgaaaatgaccgccattacggtgggtgcgtttattattgttattttaggaatccttgatgataaataccaattaagcgcaaaggtaaagtttttcgtccagctggccgtggccattatgattgtgagcacgggactgaaaatggactttttctccgtaccgtttttaacggaacgtttagaattgggatgggtcgcttacccgctgactgtgttatggatcgtcggtattacgaatgcgatgaacctgattgacggtttggacggactcgctgccggcctgtcggtcatcggactctccactatcgccgttatggcgttgtccggagggaaaatccttattctgtcactttcacttgtcgtgataggaagcacactcggatttttattttataattttcacccggcaaagatatttatgggagataccggatcgctctttctcggatacgtcatctcagtactctcattattaggtctttataaaagtgttactttattcagtatcatcattccgatcatcattttgggcgtgccgatttttgatacgacattcgccgtcatcaggcggattttaaacaaacagccgatctcagcgcctgataagtcacatatacaccaccggctgatggccttcgggctgtcacaccgcacggctgtcattatcatttatttaatcggctttattttcagcgtcagtgccatcctgctgaaaagcgcgaccatttggctttcgctgtttattatttttgtattgattgtatttatgcaaatcatagcagaggtcacagggttagtaaatgaacaatttaaaccatttaccaagttttacaaaagattggtaaagaaaaattaaaaagagcagatcatgcgaatggtctgcttttttgctattctcttattatatagaaaaacccgatcctgctcaaaggatcgggtttactcttaatagcctgttgtgccgccggactgtgtgctgtccgtaccgtttgcacctgcagtaccgttggttgaatcggttgtgccgcttgttcctgtgctgccggaagtcgaatcagccgtaccgcctgttcctgtgctgccggaagttgaatcagtcgtactgtccgttccggtgctgtcagaagcgggatcggatgccgtgctgtttccggacgggtaatccaggtgcttctgcaattcctgccgtactttctcgagattggttggatccggctggaaataatatgttccgcgcgtagttgcggttccgcctaaatataaatctgatcctgttatggtcagtgtatcaatctttttgctggtaaatccgctgtaaatctgctgaagagcgagtccttcagtgattcggatattcgtttggacattattgctcgctgtttcagcgattttatcgattttagcaatatttccagctctggacatttggtcgatcagtgcgtttaaaatttgcttttggcggtcattccggccgaagtctccgcgcttatcctgctttctcatccgcgcgtaagccaaagcctgctcaccgttcaaatgcatgtttcctttcttgaaatagatccgtttctttttactgacgtcactcatctcgtcgaagtcaaacggcacttttacatcgaccccgcctacttcatcaataacatccttaaagccattgaagtcgacagtgacatacttatcaatcggtatgcctaataagtcttcgacggttgagacggtttcatccgctccgcccttagcaaaagccgcattgatttttgttttgttgccggttgtgtcgccggcaagcgtcacccgcgtatcacgcggaatactcagcattttcattgttttatttctcggatcaagggtaacgacaataagagaatctgatcgtccgccttttccgctggtggcataattttcgatccccataaacaaaatggagaacggttttttcttcatattgatgactttatcccgcaattttgatttttctccgcgggaaagggcatcatatgcattatctgccgcattgatcgttttgtatactttgtatccgccaaatccggcagcaactaacaaaacgagggtaagcagcagcaaaatccgtttgaatatgatctttcgtttgcttttctttttctttcgaacacgcactcttacacgttcagccattacattagtctcctttagggctgacgtctgtttctaaatacgtcagttctccctctgtattcttactcttgccgttcgtcagttctgtcatccattttagaaacgcttctttgtctttttcttcaacgtacgtttcaaattcgacatgatccgcataatggatatctttcagtaaaaaaactgattctctcagttcgttctctatcttgccgagccacgtataatccgctgatgtatgcataatccgcatcagcttccgctccgtaactcctatatgatttaagccttcagacactgacttcccatatgcacgaatcaatccgcctgcaccgagctttattccgccgaaataccgggtaaccaccgcgcaggtatctttcagaccgcgttttttcagcacttccagcatggggacgccggctgtgccgcttggttctccgtcatcattggccttttgtatatggtcggtttcgccgatcagataagctgagcagttatgagtcgcattccagtgctgtttttttatcttttgtataaattcctgcgcttcctcttcagaagcagcacggctcaggtgacagataaaacgtgatttttcaatcacaatctcatgttcacccgtttctttaacagttaaatagctgtgcagcatgattgctggaccctcctgacaagcattaaaagacttgtttctacaaattcgaacagactttagaatttttgcgcatattttggtatcatgaaagagtaagatactatataaaaatgtttttttctagaatatacgcattctttcattataattcgacataaattgcagttcaattacatttataataaaaatacataacaacaccgttacggagggagacagatgaataaatcgaagatggactccaaagttttggattctatacttatgaaaatgctgaaaaccgtggacgggagcaaggacgaggtttttcaaatcggagagcagtcgcgccagcaatatgagcagctggttgaagaactcaaacagatcaaacagcaggtgtacgaagtcattgagctgggggacaaacttgaagttcatacgcggcacgcacgaaaccgcttgtctgaagtaagcagaaatttccataagttcagcgaagaagaaattcgcaacgcctatgaaaaggcgcacaaacttcaagtggaactgacgatgatccagcagcgtgaaaagcagctgcgggagcgcagagatgatttagaacgccggcttttggggcttcaggaaatcattgaacggtcagaatcattggtcagccaaataaccgtcgttctgaattacctgaatcaagaccttcgccaagtagggcttcttcttgccgatgcgcaggctaaacaagatttcggcttaagaatcattgaagcccaagaggaagaaagaaaaagagtttccagagaaattcatgacggtcccgcgcagatgctggcaaatgtcatgatgagatcggaattaattgaacggatcttccgcgaccgcggcacggaggacggatttcaggaaatcaaaaatcttcggcagaatgtgcggaatgccctttacgaagtcagaaggattatatatgatttaagaccgatggcattggacgatctcgggctgattcctacactgagaaaatatctttatacaactgaagaatacaacggaaaggtgaaaatacattttcagtgtatcggagacacggagaacaaaaggcttgccccgcaatttgaagtggcgcttttccgtctcgctcaggaagccgtcacaaatgcactcaaacattcagaatcagaggaaataacagtaaaagtggaagtaaccgctgattttgtcgttcttatcattaaggacaacggaaaaggctttgatattaaggatgctaaacaaaagaaaaacaagtcatttggcttgctgggaatgaaagaaagagtagatctgcttgaaggaacgataacgatagactctaaaataggtcttgggacatttatcatgattaaggttccgttatctctcggcctataatttgttaaatagagccaaaagacatattgaccgaacagcggcgtatatagaacaataggataaggaggcgtagcgtgtgactaaagtaaatattgttattatcgacgaccatcaactattccgtgagggtgtaaaaagaatattggattttgaacctacctttgaagtggtagcagaaggtgacgatggagatgaggcggctcgaatcgtcgagcattatcatcccgatgttgtcataatggacatcaatatgccgaatgtaaatggagtagaggctactaaacagcttgttgagctgtaccctgaatctaaggtgattatcctctccatccatgatgatgaaaactatgtgactcatgctttaaaaacaggtgcaagaggctatctcctgaaagagatggacgcagatactttaatcgaagcagtgaaagtggtagccgagggcggttcttaccttcacccgaaagtaacccacaatcttgtcaacgaattccgccgtcttgcgacaagcggagtttctgctcatcctcagcatgaggtttatccggaaatccggagaccattacatatattaacgagacgggaatgtgaagtgctgcaaatgcttgcagacggaaaaagcaaccgcggaatcggtgaatcattgtttatcagtgagaaaacagtgaaaaaccacgtgagtaatattttgcagaaaatgaacgttaatgaccggacacaagccgttgtcgtagccattaaaaacggctgggtagagatgcgttagtcatgtatgagaagacttgccataataggcaagtctttttttacagcttcatatctattaaaatacttattaagtacttaataaggcaggtaaagtgatgaagattgcagttgtaacagacagtacagcatatattccgaaagagatgagagaagaacatcatattcatatgattcctcttcaagtggttttcggtgaaaaaacattccgcgaagaaacagaactcgactggagaagtttttataaagaagtaaaaaatcatgatgagctgccgactacgtcccagccttctttcggtgaattaatcgcattgtacgaagaactgggcaaaacatatgacgcagtcataagcatacatttgtccagcggaatcagcggaacttataacagcgccgcctcggcaaacactatggttgatcatattaaagtttatccctttgattcagagatcagctgtttggcgcaaggtttttatgcattaaaggcagcacagctcattaaagacggtgttgactcaccggaagagattattaaagagctggaagaaatgaaaaaaacagtccgtgcgtattttatggtggatgatttatcacacctccagcggggcgggcgtctaagcagtgctcaggcttttatcggcggtctgttaaaggtaaagcctattcttcattttgacaataagataattgttccttttgaaaagattcggacacgcaaaaaagcgatttcgagaatttttgaactgtttggggaggatgcaagtaaaggaatcccgatgcgggccgctgtcatccatgcaaacagggaagaagaagcggcggatattatacaggagttaagcggtaaatatcctcatgtcgaattctataacagctatttcggtgccgtgatcggaacccatttgggcgaaggcgccatcggaatcggctggtgctttaaaaactaagtgaaaatctccgttttcaagggcggagatttttttattattaaattttcgtgattcgacaaaaaaattcccggcaggcatactttgaacagaaaggaggcagggagatgtccgaaggtgcttcagaattttcagaggtgcgggatttcttttacggccggcatttattgagatctgagataccgttttcagatcagcgcatcaaccgttttatagaaaaagagcatataacggccgagccgtcaatcatccgccggaaaaaccgttacgtctgccaacgatgcggtcagtctgatcaagcctgctttgcggcattttgggcgccctctgccaaaaggcagattacctattgccgtgcctgtgtcatgatgggaagggctgatgaactgacatcattatattcttggaatcaagcccctgaaaacagctgggagcctgtaaagctttcttgggaaggaacactgacagacggacagaagcaggccgccgccgcgcttacagatgcgataaaagagagacaagagctgttagtatgggcggtttgcggatcggggaaaacagagatgctgtttcctggtatcgagtttgccctgaatcaaggtttgcgcgtctgtgtcgcgactccgcgtacagatgtcgtacttgaactgctgccgagactgaaaaaagcatttgagaaagtcgacgtttctgctttgtacggcggcagcgaggacaaaggccgcttgactccgctgatgatttcaaccgctcaccagctgatgcgctaccgagacatttttgatgtcatgataatagatgaagtagatgcgtttcctttttcagccgatgagacattaagattcgctgttgataaagcgaggaagaaaaacagcgcccttgtttatgtaacggcaactccttcagacacattaaaaaagaatgctgaagccggtttgctgaaaagcgttcgcataccggccagatatcatcggaaacccctgccggagccgcgttttttgtggtgcggcaattggaagaagaagcttcagaaaggaaaactgccgcgctctgtaacggattgggtccgccaaaaacttcaatcacagctgccggttttcttattcgttccgtctgtacacgtattgaaaaagacaacggattattttcagaaattaaacatacgggcagaaggcgtacatgcggaagacacattcagaaaggataaagtgaaacgattcagagacggccggcttgatctgctggtaacgactacgattttagaaagaggggttaccgtgcccaaagttcagacatgtgtcctcggcgcagaagcacctatctttactgagagcgcgctcgtacagatcgcgggcagaacgggaaggcattataaacatttcagcggtgatgtcgtcctgtttcatttcggaatgacaaacggaatgaaaaaagcaaaaaaacatatagaacttatgaacaaattggcacaaaaaagtaaattgttggactagttaatttcagaaaacatgatacagtatactcatactttcctatgaggagctgtcagcatgcttgtcaattctaaagaaatcatattaaaggaacttctcgaccgccatatgcctaagcttcatatgaaatgcacatgccgggtatgcaaaaatgatgtactggcactttcattaaaccgggctgagccggcatatgttacagataaaaagaaagttgcttatgcaaaagcagagatagttgataaacagaaaaatacggcgctgcttgtcattctggctgaatcagccgcgattgtttcggttaatccaagcgagttctgtgaaacttgggaaggagcgtaatatctctgaattgtttattgtgtgactcaccaatttcaagttcattgacttggagatctttgttttctctggcgcccgagcaagaggtatgcaccatatgcagcagccgattcgaaaaaattgaaggccccgtatgcagtatatgcgggaggcctcaggagtcaaatgaaaaatgcgctgattgtgcggcccgggaatcaaaaacggaaaagcgctttttgctgcggcaaaaccgttcggtatatttgtataatgatgcgatgaaggactcattagcccggtttaaattcaggggtgatgcgaaaatcattcaagcatttggacgtgactttgctgccggctttaaagcggcatatccatcaaatacacatactctcatccctattccgctgagcggcgaacggctggcggaacgcggattcaatcaatccgagctgctggcctctctgctcggaatgcccgtcattttccccctcatccgactgaacaatgaaaaacaatccaaaaagagcaaaacagaaaggctgtccgcagaaaaaaagttttcagcagccgaaaactcggccgaaggtatgaacgtcatcttaatagacgatatttatacgacgggcgccacactgcatcaagccgccgaagtcctgctgacagcgggtaaagcgtcatcggtctcctcttttactttaatcaggagctaaatcattctttttttctgccgatataattgatagaaatataaggcagattaaagaaggaataggagttaatacgatgggtgaattggcgaattgtccaaaatgcaatgctttattttttaaaacgaacctgcagaccgtgtgccaggcatgtattaaagaagaagaaaaagcatttgaaaccgtctataattttttgagaaagcagatcaacagacagtcgacgatgcagcagatcactgaggaaacaggtgtggatgaagagctgatcctcaagtttatcaaacaaaaaaggattcagatcagccagcttccgaatttggcatatccttgcgaaaggtgcggaaatccgatcaggacaggaaaattttgcaagtcctgtcagacagatattgagtcgcaattagaccatatgaaccaaaaaacagccgctgaattcaaagaaaaaaacagtacaaaagacacatactatgcctataataccaaaaacacctgattccctaaactaactgataacgcagtcgataaaagaattagactgcgaacagaaagcgagaggaatcctatgaaaatcaatcagtacggaacacaatccgttaatccataccaaaaaaattacgaaaagcaagccgtacaaaaagaggctgcaaagccgaaggacaaagtggaaatttcttctcatgcaaaagagcttcaaaatgcgtcagatgcggtcactaaaacacgtcaggaaaaaatcgctcagcttaaagcggatatagagagcggaacatataaaatagattcaaacagcatcgctgaaaacatagtgaatttttataaaaagcaataaaaaggagaaagtcaatgtctgcaaagccaattattgatcaactgaagcgactttgcgcactgcatgaacatctgctcacgctgtctgaggagaaaacggaagcgctgaaagcaggtaaaacaaaagagctctccaacatattgactaaagagcaaaagtatattcaggcaatcgggcagactgaggaagaacgaatcaggttaacttctcagtttctcagccgcggtgaggacaatacaattgctgcatgcatctccagaacttcaggcagtgaaaaacaggagcttgaagggttatttcactctctgtctgcgcttcttgaccgtctgaaagaagtgaatgagatgaacaaacagctcacgattcaggctttacaattcatctccggggcattcgatatgatcatgccgggtgaaaaagagaatatgaattataaagagccgcaagcggcgcgcaagcctgtcagccgtttgacattattcgattcaaaagcttagaacggaggattttcaatgccatcgacttttatggggctcgaaacagcaaggcgtgcattgagtgcgcagcagactgcattgagcacagtttcaaataacgttgcaaatgcaaatacagaaggatatacgaggcagcgcgtcacattacaatcgacgagcccttatcccgcagtatcaaaaaacagtgatctgacggccggccaaatcggaacaggagtaaaagccggttcagttgagcgcgtcagagacagttttttagactatcagtacagaacggaaaatacaaaattagggtactatacagcccgttccaattcattgtcgcaaatggaaggcgtcatgaaagagcttgacaataacggattaaacggatcgctcagttcattttggaatgcccttcaggatctggcgacgaatccggaaaatacgggagcgcgctcagttttgcaggagcaggggaaatctcttgccgaaagttttaactatatatctacctctttgactaacattcagggtgatattaaaaagaacctggataacacagctgatcaggtcaattccattctcaatcagctgaatgaccttaacaatcaaatagcggcagttgagccgagcggtatgctccctaatgatttgtatgaccaaagagacagattgattgatcaattatcttctatggcaaatataaaagtttcatataataagtcgggcggacatgccttggcgactgctgagggcacggttaacgtcgaattgctgaacgggaacaacaattctctcggaacgctgctcgacggtaacacaaaaacagtttcagaaatgaaaatcaactacgacaaggacagcggactcgtgtcgagtgtgtcagtcggcagcagtacggtcaatgcggatgcatttaccggaaaaggctcacttttaggtcttattgaatcatacggctatatgtcaaacggagaagaaaaagggctttatcctgaaatgctgacggctcttgacaatatggcgctatcctttgctgacgcgtttaatgcagttcatgaaaaagggaagacctatacaggcgaacagggtgcagcattttttgatttcagcggtgatgaagcggtgccggcaaaaggtgcggcagcgaaaataaaagtcagtgacaaaatccttgcgtctactgataatatcgcagcgtcgttaaacggagaaaaaagtgacggcacaaacgcgacaaatcttgcagccgtacagaacagcaagctgactattaacggtgaaaccactacaattaatgacttttatgaatcccttatcggaaagctgggcgttaattcacaaaaagcggctaatcttatgaacaactctgaaagcaacaccctttcagccgatgaacggagacaatcagtcagtgcagtgtctttagatgaagaaatgacaaatatgattcagtttcagcacgcttataatgcggctgcgcggatcataacgatgcaggatgaaatattcgataaaattattaacggtatgggcaccggaggaagataggagataagtaaatgagagtaactcaagggatgatcgcaaaaaattctcttcgatttatcggctcaagttatgacaagctcgatcggcttcagcagcaagtgtctacggggaaaaaaatcacgaaagcttctgatgatccggtcgtcgcaatgaagggaatgcagtaccgtactcagcttgcgcaggtaaaccagtaccaacggaatgtttcgcaaggttttacatggctggaaaactcggaatcaagcgtaaactcggaaacggatattatggggaaaatccgggacttgatggttcaggcgaaaagtgattcgaacggtgaaacagaattgaaagcaatcggtacagaaatcggccagctgaaaaagcagctcgtttctgtcgcgaatactcaggtaaacggacgttatctgtttaacggaacgaattcagatgtcccgccgatcactgaaaatgccgacggcacatatacgtacaactatgagaattataccggtgcttcggatgttaacatcaacatctcaaacggagcagtgctgaaagtgaattctgatccaaactcagctttcggaggcgtcgcacaaaatggagataatgtatttgaatttctcaactccttagaagcttctttaagcaaaggcacgctgtccgaagcagattcaaatcaaattctgtcagatatcgacggttttactgacaaaatgaatgctgaaaaatccaatatcggcgcacgcacaaaccggttggaactcattcagacaagattggaatcacaagcggcaaccgctgaaaaagtattgtcggataatgaggatgtagaaatggaagatgtaattgttgattatttatctcaacagacggttcatagagcagcgctgtcagtgaatgcgaatatcattcagccgtcactgatcgacttcctgaaataatataactatcgtcttcaatatataaaaaaagcgactcacaacagggagatcgctttttttactaaaatactataaacaggagggatctctgtgcagatgccgagattgattattgacagtgtgcctgctaaaatcggtataacctttcaaaaggaagaaatcgagatggaacagccgcccgctgacctggaaatcgagcagccgccggcagagctgaacatcgaaagcacgccggccaaactgacgattgaccagacgagggcgtgggagaacttgaatctcaaatcatttgaaaagctgaacgctgaagccgctcaaaaaggtgcggaagcctgcagcgagtttatcgcaaaaacagtcagggaagggaaggaaatggcggctatcgaaaagaaaacgggcaatgtgatggcccggcaggcagcagatgtcagtccgcccgatccattcggcgaattcagcgactttctgcctgcgcagtttctcgtcgacattgactgcattccttcaaagcttacgattgatattgaagcccgcaaaccttcaattgaagcagctgtcaataaacctgtatggaattatacgccggggaaagttcagattgatatgatgcaagaccctaaggtgacgatttcggttgatgatggcaacgcagaataaaagatgaaagtggtaaaggattgtgaaggatgataattaaaacaaaatatcacggagaaatcagaatagatgaagggcagattatctcatttgaaaacggcctgccgggatttaatgacgagactcaatttgttgttcttcctttgtcggaagattcaccgtttttggcgctgcagtctgtgaaacaggagcacatcgcctttattgtcgccagtccgtttattttctttaaagggtacgaatttgacattgaccaagcgacgcttgagcttttgcatattgaagatatagaggacgtcgaagtgatggcgattttaacgctggaagagccttttgaaaacacgaccgccaatttaaaagcgccgattatcgtcaataaaaaggaaatgaaggcgaaacaaatcattttacatgatgcttcctatgaaacaaaacatctgataggaggaggatcatgctagttctctcaagaaaagtgaatgagtccattcagatcgggccggatattgaaataaaggtgatcgctatcgaaggagaacaagtgaagctgggaattgaagcgcctcagcacgtagatattcaccggaaagaaatctacttgtcgatcctggaagagaacaacagagccgtatcttttaatactgatttattacttaacttatcctcacaaaaaaagtgaggatttttttattttcaatataaacaatggaagcggccgtccgatatatatattgtagccaatgagaggaaaaattttcttcagaaatgacgctgcgcaaatgcacaaggacgtgcgaaaaacaattcagggaggaaatacaaaatgagaatcaaccacaatatcgcggctcttaacactagccgtcagctgaatgcaggttcaaactctgctgcaaaaaacatggaaaaattatcttcaggtcttcgcatcaaccgcgctggtgatgacgctgcgggtcttgcgatctctgaaaaaatgcgttctcaaatccgcggtttagacatggcgtctaaaaacgctcaagacggaatctctcttatccaaacatctgagggtgcattgaacgaaactcacagcattcttcagcgtatgagcgagcttgctacacaagcagctaacgatacaaacacagattctgaccgttctgagcttcaaaaagagatggaccaattagcgtctgaagtaacaagaatctctactgacactgagttcaacacgaagaaacttcttgacggaactgcgcaaaacctgacgttccaaatcggagctaacgaaggccaaacaatgagcctgtctatcaataaaatggactctgaaagcctgaaagttggtacgacttatacagtatccaatgatcaaaatacattgacatcaactgacggaaaaagcactgctacttgggcggatgaagtaacagatccagatggtaaggttacaaaagcagccggctattatgatactgacggtaaagttattgcatctgaaaaattagctgcagattctaaagtaacaaaaggtatcgacatctcttcttcagctaaagctgcgtcttcagctcttacaacaatcaaaacagctatcgacacagtatctagcgagcgcgctaaacttggtgcggttcaaaaccgtttagagcacacaatcaacaaccttggtacttcttctgagaacctgacttctgctgaatcacgtatccgtgacgtagacatggcttctgagatgatggagtacacgaaaaacaacatccttactcaggcttctcaagctatgcttgcgcaagctaaccaacagcctcagcaagttcttcaattgcttaaaggttaatgacggaaagatcctggttctccagggtcttttttttatttcttcagctaactcctccttcagcaagccaaagaaccctattgacaaaatgaaacattatattttgcagttaaattattgaaaaccttttaatatgaccgatataagaataagatcatacatttatggagctgtgatatgataaacagtcggaaactcactgttgtcatagagccgtctacgactaaacgccgaaaaggagagggtacatatggtcacaagaatcacaggccttaattccggtcttgatgtagattctctggtgaaaaaaatgatggatgccgaaaagcagccgcttaataaattaaaccagcaaaagcagacgcttgaatggaagcgcgatgcttatcgggaaatgaatacccagattgccgacatgtattctactacatttaataatatgctgatgtccacaaactggaataaaaaaacagtaacaagttcggattccagtgtcagcgcggtggccgtcagtgccgaacagaatatttcaacgagcatgtctgtacagcagctggctacgccgacgacttataaatcatcaggggccatcaatttcacttcgggtcaaagccaaacattgaaattcaatgtcacaaatccgggggaaacgaagccgactgaggtaaacgtcacgatcgccgcaaccgatacgattgacgatgtcatttctaaactgaacagctcgggtctcggagtgacggctttaaaagagaaaatctctaacggctcggattatgtggacacgattgcgttcacttccaataaaacgggggaagggtttaccctttcagcaggtgatgacgcgaccaaaagctttctgaaagatcagctcggttttgccgttgatgatgcaacaaatgcactgacggccaatgccgaagggaaaaacgcgaagtttacgttcaacgggcttgaaatgacaaaaacgtcaaataactttacgatcaacggcatcaaatacacgctgaacagcgtgacggacagcaacaaaacggttacgattaacagcacgactgatacggacggcatttttaacaacattaaagatttcgttgataaatacaatacgttaattaaaagcgcaaatgagaaggtgacagaatcaaaataccgtgattataagccgctaaccgatgaacaaagagaagcaatgaccgataagcagattgagcagtgggaggcaaaagccaaaagcggtttattacggagcgacagcacgctgcagaacggtttggcggagatgcggcttgatctgtactcaacggttacgattgacgggaaaaaatatcagcttgccgatttcggaattgagacgtctgatagttatacggatcaaggaaagcttgtcattaaagacgaagcgaaactgaaacagaaaattaccgagaatcctgctctcgtggctaaactgtttaatgcagacagccctgatacagcgaaaaccaaaaacccggaggaacaggggattgcccggagattaaaagacacattaaacaaaatgcagattcaaatttcaaaacaggcgggtacggaaagctcggtatcaaccagctttgccatcggaaaaagcctggatgaaatagaaacaaatatttccaatatgaaaacgaagctggatgacatcgagacgagatattataaaaagttcagcgcactggatacggcattggagaaattgaacagccaatcttcatatctcacgtcaatgttaggatcttcaacttcataaccttgggggttttataaaaatggcaataaataatccttttgctgcttaccagcagacatccgtctttacagccgctccggaagagctgacccttatgctttataacggctgcctgcgattcattaagctggcaaggcaggcgatgaagcaaaacaaccttgaagccaaaaatgaaaatatcgtaaaggcgcaaaacatcattcaagagctcagcatcacgttaaaccgggagattgagatttccgagcagatgtcatccatttatgattacatccgccgccggctgatcgacgcgaacgtgcagaataacggagagtttttagatgaagcggaaaagctcgttactgaatttcgcgacacgtggaagcaggccatgcagagtgaacggaaaaacagccatggcgcgggcggccttgcctgatgaacagcaatgtcttttctttgtataacgaaacgaagaacatgtacgccgcactgaaggacgccccggaaagcgacggtctcatcagcagcgttacggcatttacggagaaaagggaggagatgcttgcgggcataaagccgcctttttccgaagaagaaaaaacgctgcttcagcaggtggccgcgatggaccgtctgattaccggcgaagtgaaacggattcaggatggtatccgaaatgaaataaaaacgcttaagaaaaaacgaatctaccataatacgtatttcaatccgtatcagcaaacgacaagtgacggccgttattacgacaaacgcaaataggtgagtgttttgagaagtttgaacgattaccatttggtgtcagcctattaccagcttctttttacgattgatgaggggctttgctacctgttggacacgcaggatgatttttttaagacggagggcgagcggatttacaacgatttgattcaggctttttttcatctcgattcctctcatgcgcttctgctgtctatcattgagtgccgatgcgtggagacggcgatccgctcatttgacgagatctttcaggatttcagcatgttaaatgattatgatttcccgtccgccccttttcaggagtttttaaaaaccatctttctgccgcattataagctatggatggagcagacgcacgactgtatcaaaccgtatgttcttcactagacctgctgcaagcggcaggtcttttgcctgcgtcctttgcatatacttataatcctgccggaagctgccggataaaaccgacaccattcgtcatcgttcaccgaatttacacattattttaacgtttcagcagggatcagaaggggtaaaagagaaatagttacatatccttagataaagggaggcgttctttgatgaactacaatatcagaggagaaaacattgaggttacacctgcgttaaaggatcatgtggagagaaaaatcggcaagctggaacgatatttcgagcagagcgtcaatgccgatgtgaacgtcaacttaaaattctataacgataaggaatccaaagttgaagtcaccattccgatgactgatctggcgcttcgttctgaagtgcataacgaggatatgtacaatgcaattgatctcgcaacaaacaagctggaacgtcaaatccgaaagcataaaacaaaagtcaaccgaaaattccgcgagcagggtcttccgaaacattatttcgagaacggcagcgctgctgatacgggcgtagcggttcaggacgaaattgaagatgacagcccggaaattgtccgtcaaaagcgttttaatttaaaaccgatggataatgaagaagcgattctccaaatgaatatgctcggacataatttcttcgtattcaccaacgcggagacgaatctcacaaatgtcgtttaccgcagaaatgacggcaaatacggattaattgaaccgactgaataaacccacccagccttccgtgaacgcgcggaaggtttttctctatctttatctgcaaattctttggaaatagcaaaaggtatgttatgataatgagaggtatacatggacagaaaattatcatttattccatgcaaaatctgcatgtgaacatagaggagcgttatagatgcttgggattttaaataaaatgtttgatccgaccaaacgtgcgctgaacaaatacgaaaaaatagcaaatgacattgatgccgtaagaggagattatgaaaatctttctgacgaggcgcttaaaaataaaacggcagaatttaaagagcggcttgaaaaaggagaaacgacggatgaccttcttgtcgaagcgtttgccgtcgttcgtgaagcttcccgccgcgtaaccggcatgttcccgtttaaagtgcagctgatggggggcatcgcccttcatgaggggaacatttccgaaatgaaaacaggggaagggaaaacgctgacgtctacgcttcccgtgtatttaaatgccttgacgggaaaaggcgttcacgtcgtaacggtcaacgaatatctggcaagccgtgatgcccagcaaatgggagaaatctttgcgtttctcgggcttacagtcggcctgaacctgaattcaatgtcaaaagacgaaaaacgcgaagcttacgcagccgatatcacgtattcaacgaacaatgaactcggctttgattatttgcgtgacaacatggtgctctataaagaacaaatggtgcagcgcccgcttcattttgccgttattgatgaagtcgattcaattttagtcgatgaagcgagaacgccattgattatttccggacaagctcagaagtccacaaaactgtacgtgcaggcaaatgcgtttgtccgcacgctcaagaaagatcaggattatacgtatgacgtcaaaacgaaaggcgttcagctgacggaagaaggaatgacgaaggctgaaaaaacgttcggcatcgacaacctgtttgacgtcaaaaacgtggccttgaaccaccatatcaaccaggctttaaaagcccatgcggcgatgcagaaagacgtggattatgttgttgaggacggccaggtcgtcatcgttgattccttcaccggccgtctgatgaaaggacgccgctacagcgaaggtcttcaccaggcgattgaggcgaaagagggcctggagattcaaaatgaaagtatgacattggcgacgattacgttccaaaactatttccgtatgtacgagaagctggccggtatgaccggtaccgcaaaaacggaagaggaagaattccgcaatatttataacatgcaggttgtatccatcccgaccaaccagccggtcatccgtgacgaccgtccggacttgatctaccgctcaatggaagggaaattcaaggcggtggcggaggatgtcgcccagcgctacatgaccggacagccggttcttgtcggtacggttgccgttgaaacgtctgaattgatttctaaacttctgaagaataaagggattccgcaccaggtactgaatgccaaaaaccatgagcgtgaagctcagattattgaagaagcgggacaaaaaggcgctgtcacgattgcgaccaacatggcgggacgcggaaccgacattaaactcggcgaaggcgtaaaagagcttggcggtcttgcggtcgtcggtacggaacgccacgaatcccgccggattgacaatcagctccgcggacgttcaggacgtcagggagacccgggcatcacacaattttatctttcaatggaagatgaattgatgcgccgtttcggagctgaacggacgatggcgatgcttgaccggttcggtatggatgactccacgccgattcagagcaaaatggtgtcacgcgccgtggaatcatctcaaaaacgtgtcgaaggaaacaacttcgattcacgtaaacagcttcttcaatatgacgacgtgctccgtcagcagcgcgaagtcatttacaagcagcgttttgaagtcattgactctgaaaacctgcgcgacattgtggaaggcatgatcaagtcttctctggagcgtgcgattgccgcttatacgccgaaagaggagcttccggaagaatggaatcttgacggcctcgtggagctggtgaattcaacgtatcttgatgaaggcgcgcttgaaaagagcgatatcttcggaaaagaaccggatgaaatgcatgagatgatcatggaccgcatcatgacaaaatataatgaaaaagaagagaatttcggtacagagcagatgcgtgaatttgaaaaagtcatcgtattgcgtgccgttgattcaaaatggatggatcatattgatgcgatggatcagctgcgtcaagggattcaccttcgcgcttatgcgcagacaaatccgctgcgtgaatatcaaatggaaggcttcgcaatgtttgagcacatgattgagtccattgaggacgaagttgcgaaattcgtcatgaaggccgagattgaaagcaatctggaacgcgaagaagttgttcagggccaaacgacggctcatcagccgcaggacggcgatgaggccaaacaagcgaaaaaagcgccggtccgcaaggttgtggatatcggacgcaacgcgccttgccattgcggaagcggaaaaaaatataaaaattgctgcggccggacagaatagtctcgactgtatgaagcgaacatgaccgggtctgcgtcttatggcgccccggatcttttaatgaggtgaatggaatggaattatcagaaatcagggcagagctcgaaaatatggcttctcgtttagcggacttcagggggtctctttgacctcgaatcaaaggaagcccgcattgcagaattagatgaaaagatggcggaaccggaattctggaatgaccagcagaaggcccaaaccgtcatcaacgaagcgaacggtctgaaagaatacgtgaactcctaccatcagctgagcgagtctcacgaagagctgcaaatgacacatgatcttttaaaagaagaacctgaccaggaccttcagcaagagcttgaaaaagagctgaagtcattaacgaaggaattgaatgaatttgagcttcagctgctgctcagtgaaccatatgacaaaaataacgcgattttagaacttcacccgggcgccggcggtacggaatcccaggactggggttccatgctgctcagaatgtatacccgctgggcggaaagacgcggcttcaaagttgaaacgcttgattatctcccgggagatgaagcaggaattaagtcagtcacactgcttattaaaggccacaatgcatacggctatttaaaagcggaaaaaggcgtacaccgcctcgtgcggatttctccatttgattcatcaggccgccgtcacacgtcattcgtgtcatgtgaagtcatgcctgaattcaatgaagaaatcgacattgatattcgtaccgaagatattaaagttgatacgtaccgggcgagcggtgccggcggacagcacgtcaatacgactgattcagccgttcggatcacccacctgccgacaaatgtagtcgtcacatgccagacggaacgctcccaaatcaaaaaccgcgaccgggcgatgaaaatgctcaaagcgaagctgtatcagcgcagaattgaagaacagcaggcggagcttgacgaaatccgcggcgaacagaaagaaatcggctggggcagccaaatccgctcgtacgtcttccatccgtactccatggtgaaagaccaccgcaccaatacggaaatggggaacgtgcaggcggttatggacggagatatcgatatcttcattgacgcctatttacgttctaaactgtcgtaatccgggaacacacctgcctttggcaaggtgtgtttttttatccgttctctttttccatttttcacaacagcgctttagcaaattaatacggtatttggctgttatttacttctaagccgggaagacttaaaatgctatcgagagaaaatcggagaacggaggattttgcatggatgtgaatcacaataagccgctccgtctgatcaaagattacatatatatcatgatcggcgcggcgattacgggggtcgtgtttaacgtatttttgctgccgaaccgtatagcagcggggggagtaagcgggatcagcaccattttagaaacgtttggttttgaaccggcttatgtgcagtggattattaacatccctttgtttatcgccggagtgatcattctcggcgggaagttcggaatgaagacactggtcggttccatcgttctgccgcttgccgtctttttaacaagagatctgcctgccgcgacgacccatgaactgctggcggcgattttcggaggcgtcgggatcggaacgggaatcggcatcgtgtatctcggcaaaggctccacggggggaacggctctggcggcgcagatcattcacaaatacacggggctgtcgctgggaacgtgccttgccatcatggacggattaattgtgctgagcgcgatgctcgttttcggagtggagcagggactgtatgcgatgctcggggtatttatttcaagcaaaacgattgatgtcgtgcaggtcgggttcaaccgctccaaaatggctttaatcattacgcagcatgaagaagccgtcagatcagctgtgtttaaagaaatcgacaggggtgtgacgaagatttccgcagtcggcgggtatacggaacatgaccggccgatcttaatgtgtgtcgtcggtcagaccgaattcacaaaactgaaacaaatcgtcaaacaaattgatgagtcagcctttgtcattgtcgcagacgcaagcgaggtgctcggcgagggtttcaaacgcgcgtaaacgaggttataatagcgaaggggtgcatcttacatatgaaatcaaaatgggcgctgctggcgctggttctgaccatgtccgtcctgctggcggcatgcggcggatccaatgaatcgaaaaaagaaagctctgacagctcaggcggatcaaaagcatctgcgtcagcgggtgaagaactttatcagcaaagctgtatcggctgtcacggtaaagacctagaaggcggcggaggtccgaatttacaggaagtcggcgggaagtatgatgaagctaaaattgaaagcatcattaaaaacggacgcggcaatatgccgagccatcttgtaaatgatgaggaagccgtgaagatcgcaaaatggctgtcacagaaaaaataacagaaaaaccttgcctgttataggggcaaggttttttctcggtctgggaatgaaaagaaactgtaatagtaatatgtctaaatttgacgtataatgaagtgtactgaggaaaaggaactttcagatttttcatctgtttcctgacgaatcggccataaaccgctgtatgtttgcgaactctatggctgcaagacataaataaaagattaggtgatttcatgatagagatgaaagaagtatataaatcctatccgaacggtgtaaaagcgattaacgggctgtcagtcatgattcatcccggggaatttgtatatgtcgtaggaccgagcggagccggtaaatctacttttattaaaatgatttacagagaagaaaaaccgacaaaagggcaaatattgattaatcataaagatctcgcggctgtgaaagaaaaagagattcctttcgtgcggcgtaaaataggtgttgttttccaggatttcaaactccttcctaaattgacggtatttgaaaacgtagcgtttgcgcttgaggttatcggagagcagcagtcagtcattaaaaaacgcgtgctcgaagtgctcgatcttgtgcagctgaagcataaagcgcggcagtttcccgaccagctttccggaggagaacagcagcgtgtttccatcgcaagatccatcgtcaacaatcctgacgtcgtgatagctgacgaaccgacgggcaaccttgatccggtaacatcatgggaagtgatgaagacgctggaagagattaataaccgcggaacgaccgtcgtgatggcgacacacaataaagaaatagtaaacaccatgaagaaacgggtcatcgcgatcgaagacggaattattgtgcgtgatgagtcaagaggggagtatggttcttatgattaaaattctcgggcgccatttgcgtgagagttttaaatctctcggaagaaacacgtggatgacatttgcatccatcagtgccgttaccgttacattgattttggtcggcgtgtttttagtcattatgctgaatttaaacaacatggctaaaaatgctgaaaaagaagtggaaattaaagtattaatcgatctgacgtcaaataagaaaacgcaggatacgctgcagaatgagataaaagacatttcaggaatccaaagcgtagagttttcatctaaagataaagagcttgatcaattggtcaaaagcttcggcgacagcggaaaggccatgaaaatgcaagatcaggaaaacccgctgaacaacgcgtttatcgtcaaaacgacagatccgcatgatacgccgaaagttgcgaaaaaaattgagaagcttgatcatgtgtataaagtgacatacgggaaagaagaagtcagccgtctgtttaagatcgtcggggtgtcacgcaacatcgggattgcgttaatcatcggccttctgttcacggcgatgttcttaatttcgaatacgattaaaatcacgattttcgccagaagaaaagagattgaaatcatgaagcttgtcggcgcgacaaactggtttatccgctggccgttcttcctggaagggctgctgctgggggtattcggttctgtcataccgatcgctctcgtgctgagtacgtaccagtcgatggtcgcttgggtggccccgaaagttcagggatcatttgtttcacttctgccgtacagtccgtttgtgtttcaagtatcacttgtgctcattctgatcggcgcggtgatcggagtatggggaagtctgacttccatccggaaattccttcgtgtataaataaaaaagccagtctgatacagactggctttttttaatggtttcgttactgaatgacgggcagggccggtgatccgggctttaatgtaaagtcataagacgattcgtcacggtacatcgggtccgcataaatggaatccgaatcgtttgccgttccttttcggtacgctgtgaatgaatcatattctctgttcttccaattccagatgccgtcttttccctcttctttgtgatagacgttatgattaacggtattttcttcgtttttcgtaaaatcatttgcgataaaaatccgtgaatcgcttgccgtcatgatgtttttttcgatcgtgttcccttttgtgccgtactgcaggagcagctggccgccgtcaaggtccttcgtgtcatttcggtacatgatgttgtgagcgatcaccgaattgatggtgccgccgcgtttcgtgtcatagcctccgattgaaataccggtgtatgcattgccgtacaccttgttatccgtaatccggatatctcgtgcgtatttccctttatgctcagaggtggcttcaatcccaaggtcattgttgtaaacggtgtttttcttaatgtccacatgttctgcgccgtcaacgtaaataccgcccgctgaatattcatctccgtaagcgggatttccgtaagaagagttatggctcaccgtattgttttcaatgacgccgtttcgcgcatagtcgttttgcttggacgttccttcgtatccgatcacgtcaatcccgatattgttattgtcccggatggtattgccggcaatcttaaatccgtcgacattcccgttcagcacgaccgcttcgcttgcgccgagcgtcagtttttcaaccgtattatttgtaatgctgacatccttcatggcacctgtgccgtaaaatgcgatgccgtgtgcatttccttcatcagccgtggttttaatgttccggatatggttgccgtcaatgttgatatgactgcttgatccggtgacgcagatccccatggccgtcgcatcttctgatgatacggagagattctcaagcgtaacgccgtgaatggtaatgtactgtttattgcggatttgaattaacggagtttcagaatcgctttttggcgcagatttgccgctgattgagacatgctcattctgatagttccgaaatgtaatcggcttttcggccgtgccgctgtgctttacttcaaacgtttcatcgtacgtcccttcccgaatcaatacggttgttccggcctctgccttttcagccgcatgttttaatgtgcggaacggcttttctttcgttccttcatattggtcgctgcctgcgggagaaacatacaaggcgtccgtctgcgctttctcattggcctctgtttttggccagacaaaggcggtaatgcctgcggccagaaccgccgcggataaaatcgataattttattttcatatcgcattctcctgtatatttaatgaattgcatacaaaatattatacgttacccatatatatgaaacaatctcgctttttcatttttttgttgccgttacatgaattctttgcaatttacacatactatctccaggttttcgttaaaggactaagaggaggtaaacgatgaagcagaaaatgatcgcagtgatagcggccctaagcatgatgtgcggcggagcccatattgccggggcggcacagccgaattcatcagacgcagaaagaacccgggcaatggaaaaaatcgaaaaagcatatgagctgatctcgaacgaatacgtggaaaatgtagataaagaaaagcttcttgaaggagcgattcaggggatgctgtctacattaaacgacccttattccgtttatatggacaagcagaccgctaagcagttttccgattctcttgattcttctttcgaagggatcggcgctgaagtcggtatgaaagacaataaaatcattatcgtatcaccgtttaagcaatctccggcagaaaaagcgggcctcaagccgaatgatgaaatcatcagtataaacggcgtgtcaatgaacgggaaagatataaacgaagccgtgctgaaaatcagaggaaaaaaaggatcgaaggtttctattaaaatacagcgtccgggtactgaaaaacagctgtcattccggattaaaagagcggaaatcccgcttgaaaccgtatttgcttcccgcaaagaatcaggcggtcatcatgtcggctacatcggcatatcgacattttccgagcataccgccgaggacttcgccgcggcgctgaaaaagcttgaaaaacaagggattgacggtctcgtccttgatgtaagggggaatcccggcggctaccttcaaagcgtcgaacaaattttaaagcatttcatcacaaaagacatgccgtatatccaaattgcggagcgtaacggcgataaaaaacaatatttctcaaccttaaaacataagaagccgtatcccgtcaatgtcattacggataaaggaagcgcctccgcttcagaaattcttgcgggcgcgttaaaagaagcgggacattatgacgttgtcggcgacacttctttcggtaaaggaacggttcagcaggccgtgcctatgggagacgggagcaacattaaattgacgctttacaaatggctgacaccgaagggcaattggattcacaaaaaaggcattgctccgacaatcgctgtgagccagccggattattttgcggcgggaccgcttcagctgaaacagccgcttcagcctgatatgaacagcgcggatgtcaagcacgcccaaatcctgctgaaaggcctaggcttcgacccgggcagagcggacggctatttcagcaaaacaatgaaaaaagccgttctggcgtttcaagaccggtacaagcttgataaaacagcggtcattgataaaaagacagcggaaaaaatgaatcagctgatgaatgaaaagaaatctgacgaaaaaaatgatttgcagctgcaaatggcgttaaaatcattatttgtaaaataaatgaaaaggaggcgttttttgcgtctcctgtttcttttgtcattcataaaaagtgaaccaaaagacatataattatgacggttttgacaagatattaaaaaaattttcacatttaaacatttataaaggacaaacattacccgatatttatagagaagagagactttatgccgatttaatatgtattcaaaatgaaacttttgaaagttgcctcagtcagttttagttcttacaataaaagaaggttctaatagagaacagttttagtttggcagctgcatttcagtatcgaaagcagaagtgtttgcggcgcttcagcacggcagctgtaatcacccgtgcttatctggataaaaaaatgggggttcacaattgaagagggcaagtattgtgcgtgaaaaaaaatattatgaattagtggaacaactaaaagacagaacaaaagacgtcacattttcatcaacaaaagcactaagtcttcttatgctgttcagcagatacctggtcaattacacaaatgttgaatgcgttcacgaaatcaatgaagagtgtgcgaagcattatttcacttacttaatgaaaaaccataaacgtttaggaatcaatctgacggatattaagcggtccatgcttctgatcagcggcgtgatcgaggtggaggttgaccactatctgaaagatttctctctctcaaatgtaacgttgtggatgacggaagagagatagacgtttgagatattcaagccaatgattatttggtagaatagaattaaaatgtttggcttgaggcggtgaaagcagtgtctgttcaatggggaattgaacttctgaaaagtatcggtctgttttttttgcacccgatgttctggttttttatcatcataagtctcgcatgcggatatttgcggatcaaacgtgaacgccatacgtttcatacaaagatcgcggatatgtatgacgagcttatctttacatacataaaaggacttataccgggtattcttctctccatattattttttggacttggaatttcgattccattcggtcttctcggcataatcgcggctgtgactgctttgctttcgctgacgttccgtatgaattggctgtcctcagcttatattgtcagcgccggcatgttcattgcgtttatccttcagtatacccacacagtgccgtttgcggatcggtttccgcaggcattcggcgtgaattgggcatcggcggccgtgtttatgggccttttgattatcacggagggagcggctgcctgccgttcagcgcatctgaaaacatctccggcgcttgtcgtcagcagcagaggcctgcccatcggccgacaattggcgaatcgcgcatggctgcttccgcttttcttattggtgccgggcagcgggcttgagtcacacctttcttggtggcctgtctttaccgtaccgggcggctctttccatttgatctggattccttatatcgccggcttcggacagcgtgtgcaggggtcacttccggaagtcagcataaggataacggcgaaacgtgtcatgattctcggggttatcgtgaccgcattcggggcagctgccctttggtggactccgcttgccggagctgccgcttgtattgcggtgctcggacgcctgtttttatcattgagacagcggctgaacgataacgcggctccgttttatttctctaagcgggatcagggcttaatggtgctcggcatcattccgaatacacccgcggacgatcttgagctgaagatcggtgagattattacgaaagtaaacggcatccccgtgaaacatgtatcggatttttatgaagcacttcaaaaaaaccgcgcatttgtaaaaatggagatcatcggcctgaacggtgagatccgttttgatcagcgcgcgtcctatgaaggcgaacatcatgaattaggtattttattcgtgcaggatgaacacgagcacgaagaaatgacagcattataatgtgatttttcataattattcggaatagtttcaagaactcctaaactagatttcaaaatcagttagaaagtaaaacagctaagaaaattatattttcttagctgttttattttgaaataataaaaaaataaatgaaggagaggtatggcttattggaaaggttattgctaactccaaaacctttagaagatgaatctttagcaggatatatattaagaataactgattataatggttatgttggatagggggagtacattataaaaaagcttttacttaagagattaccgttgatttcacttggagttatagcttacatactgacaaaatacgcgcagaaccatcaggattgggcggaaaaatacagtaggtctgtatatccgttattgtcaaaaatagtaggatttgtaccttcttgggtcaagttttctgttagtgaatggctcgtcgtgttggttgtgttactttttctattttatatcgtttattatgtgcgcaaggttatcatgagtaaaggtgtacgtaggatggtagtttatcgtggtgctctaggaatagttacgatctgtagcgtgatatatttttgttatactattttgggtggaataaactattacagatattcttttttgtcttataccgaatataaagaagagaactacagcaaggaggaactggtcaaattgagtaagtcgcttgccgttgaaatggaattggcaagggaaaagttagcggacactgatcttttggctcaagtaccagaggtttttgattattatgcacaacacgcagtgttctcgatgcaaatgttatcaaaggaatatcctattttggagcattctttatactcaacaccaaaaccagttgtgatgtcaaagctaatgtcgcatgcagggataaatggcatctttgtcccttttacttatgaatccaatatcaatgttaatgtgcccgttttcttggtgcctgctactatggcacatgaattggcacatcagagtggtttcatgcatgaggatgaggcaaattttatagcatatctggcatgtaagcagcaggatgatccaatgatactttacagtggtttttttctagcatttgtttattctatatctgagctaaagaaagtggatccagatcaggcgtctgatataatgtccagtctgtccaaggcggtgcagcatgatatagaacaaaatgagcagtaccgggataagtatgagggtgttatttcaagtatttcaagaaatgtaaatgatgtatatctgaaggcaaataatcagacagacggtttgaatagctatagtgatatggtgaatttgttgctggcagagcagcgagatagagaagtacaattaaatgtatcttgaatacttataggtttatatagtaatgatagtgggctcaagttgaacataggagtgagtgaaataaataaaataaaagacggcggccgggctttttacggccggattacgatgtcagcgccgaacttgatcggaactctcagccatttacattccccttttctcttgtaaatcaaaagattcttatagagcaaacggcattgcggtgacactttgagagagaaaatgaagaaggaaaactagaaaaggttccggaaagctgatgcttacggaacctttttcgttatgccgaatggctttttttcgtctgaacggtttccccggacttaattccaagcgatacgaacaagccgatcacagaaactccgatcaatatgataaacagaatatgaaacccggagattaaaccgatcagtgctgaagaaataatgcttccgaaataacggaaggtggagaaaatcccggatgcgatgccggacatgcccggttctaccgtcgcaagagaagatacctgcatgctcgtcagccccgcacctgacgcgatgcctcctacaataagcgatgccataagaaacggaacggaatgggaataaaccaaaagcagaaataagagattggctgcggccatcagcccgaaggacagaaaaatcattcttcgcgcgccccatttctgatgcagctgagctccgccccagttgctggcggacatgaaaacagaaaagactgacagcgccatgccgctgtgcgacgtgttcatgctgaagtggccggtcataaagagcggcataatcaataacacggcgtacatcattaaattgcttaacagaaccgacagattggcgctcgtaaaggtcgtgtttttaaacaggtcaaaatcaataatcggatgtttcgtgcgcagttcccgcctgaaaaatagcggaaccaatacgagaatgagcagcgcgtacacccaatagcccaaagagctttcatttttcgtcagaagaataatagatacaatgcttccggcaagcaaaacggacccgatgatatcaagcggagcgtcagacgtttcttctttatatttaggaaacatcattaatgccgtcacgagtgcgatcgcaagaaacggaatgttgacccaaaagatcgaatgccagctgaagctctcaattaatagagagccgataaacggaccgagagctgcgcccagcccggcgccgaggccgaaaaagccgaatactttcggaagccgtttttcagacacgacatggcggatgatggcgatgctgtttggcgtaagcaaagcgccgccggcagcctgaagcgcccggaagaaaatcaataagaaaagacttggcgagagggcgcaccccaatgatgcgatgagaaaaaggccgacgccccataaatacatttttttgtttccgtacatatcaccgagtttgccggcaatgggctgtgtcacggccatcacgattaaatacacggtcactacccatgtgatgctggcaattgattcgctgaatgagcgggaaatggatgaaagggcgactgcgatcatcgtagaattgatgggaacgagtatggctcccagcaaaagcgaaacgatcagcgcccattctttctttgaacccatccttcatcctccttggagccggaaaatgaccggccggtaatgcctttcatgaaaatctcagtgctgtgtttcagcatcgtttcctcagagagagtaatgactcttttccccagctgcagccggtgtataaaataaccgaaaatcatcgtcataaagacgtctgcattagcttcttcgctgccggggcttatcatatttttctttgtcagctccttaaagtaaacgattaaatgctttttcacggattgcggatatacgacaatatcctgcaggacgtcttcgaatagttccggttcgcgcaggcagatgcggaacacttcttttttttgttccaattgctgcagaagggtcgtggcgaaatgaagaagatcctcatacagatcgccttccgccttggtgatcatgctttccggaaccggcgcctgctgttcaatcatggctttcattaatccttgtttgtttttaaaattacggaaaatcgttgcttcgcttacttttgctttttctgcgatttcctttgttgtcgctgcgcggtatcctttttggatgatcagattcatcgcggcgtcaataattctcttgttcgtcgttctcaacatgtttcacctcgcgtaaatactggcaggacaagtatacacccgccctgcccgtcaataaagagggaaacctagcatgaagcgcgtttgacaattgtaatcttgccgtttgtcccgtctaccgtgacgatatctccgtcgttgagcctgtcagtcgcggcacgtgtgccgagaacggccgggagcccgtattctctcgcgatgatcgccgcatgtgacaggatgccgcccgtgtccgtaatgacggcctttgcatcctggaacagactggtccaaagcggtgtcgtcattttgcagacaagcacgtctcctgttgaaaaacgggaaaattcacttgcgtcacgaatgactttcaccggtccgcttgcgattccgcttgacgctgcaagtccgtaaatttgatgttcagtgtttttttcatcttctgtgatggagccggtaatctgttcagccgttttcagctgttccgaagtcggagtcccgagataagcgggggcttcaagcaattgatattgcttgaagagccgttttcgttcagcggctttttcctgcatcggaaccggcgacgccagcgctttctcgacttcatcgctgtataagtaccacatatcctcccgatcatcaattacgccttgtttttgaagcagctcgccgattttcagaaggcaaaggcgcgctttggcgtccagcatcgcatcaatataaaaatggtgatcatctttgatgacggatgaagacaatgtccactgataatagcggtcaaacgtctcccggaagccgtcatcttcaattctatccataaagtcggcgtagagctgttttcgtttttctatcgttttatgaaactcactgtcaaaatcgtatccgtttcggacatagttctgaatgttggccaaagcgaaataagggttttccgcccaagtttcttcaatgagatcatgacttttcacggatctccagccgtattcctgtaaaaattcgccgacttgttcaagaaagcgttttccctcatttgattgcagaagcgtctgatgcagctcatcggcatgagaaaccgtaaagacgcgccgcagctcagggctgtcttttacttgtccggaaagcagccagagctgtctgtcggtctccaatgacttattcatgacgccggccagcatttcatacagaagggaggtgttttctttctcaacctgtccgtacatagattccagtatcatgtttaacgcaacctgcggaaagacaatattgaaatgttctgcgtatccttttaaatagaagtcttgcaggtttcggaacgcatcaatggcagtctccggcgtatggtctgtatgcgccagttcgtccagcttttgataaaaaggcagaaaggtttcctgaataatattgtacatgcggtcagccaagacggggaaaagcgcttctaactgttctgcgggcagcttgtcgtccgtcttatgctgtctggaaaaaacatggccctgatgaagtttgacacgctcaatctcgatgcccatcacagggaaggccttcgtgctctctttgagaccgtattccaaagccggcacaatgagtgaagcgaataacgggctgacgggaccttctatattggactccatattgagccaaaaatctttctgatcccggggcgtcatgataaattcccgttcttcgtctgccgctttctgatcctgcgcgatcgttgtaatcggtctggcctgaagcagatagagcttattttcggcaaatccgaattcgagatccacgggataaccgtacagttcctccgtctttatcgtcagcatggcaagctctttgacgctctcgtcatcaaggcagaagcggtttctcatgtcagcggacgtctctttttccgtcacgccttcgtctttagagacgatatacatttcttttaagccgatttctttttcaatctgaaatgtgtctttattgacgataaatgtgtcgggcgtcacgctgccggagacgattgcttctccgaggccgtagctcgcgctgatcatcagttctccgtcatcatgtgtgacggggttgcggctgaaaatgactcctgaaacctcggaattgatcaaaccttgcacgacaacgcccattaacggttctgcggtgtcattgttcattttctctttataaccgctgacccgcgccgagaagaaggaagcccagcactctttcacttttccgagaaactcttcttcagttttgatatttaaataggtttcgtactgtcccgcgaaagaagcgccttcaagatcttcggacgcggaggaggaacgtacggcgacagaggcgtatgattctctcaattcataaaacgatgcggtcagctcctcccgaagctcttttgaaaacgtgccgttcataatggcgcgctccagctgttcctgatctgcttgaagcccgttgtcttccataaaacgtgtcagggcattcgtctgaatgataaaaccgccgggaacgggcagcccgtttttcgtcagtttaatcaggttcattccttttgctcctgcagagcggctcgattcttccgctttttgaaatcgcactgaatacatgcggtatgaccccctttttttcttcatccaagaaaatgatagtaaacactatcattacattgtaaagagggaggaagaaactgtcaaagatacaaagacctaaaccttctcatcctttcggctgaagaaaggtaattcgattcatctggttaatggttcaatggatttatattcacattttctttgacagatgattgaagactgccgaaaaagggtattgtgatagcaggggaacgattgtccgattcttcattttttactataatcagatgagatgaagaattcccgaggagggtttttgtgattacaaaagccgtttttgcattatgtttcccttttatgctggtcgtcctttttacgcgcgtcacgtttaaccactatgtggcgatcgctctcacagccgcactgcttttcgcatcctatttaaagggttacaccgaaacgtattttatcgttggattggatgtcgtatcgctggtggccggagggctgtacatggccaaaaaagaagcagacaaaaagaaagacaatgcctgacatggtgaatatgaaatagaatgcctgcttttacgccataaaagcaggttttttatacaaaaattgacttggtaaaaataaaccatcgaactttagttcgtatttttagtgattttgcccgtcattgtgttactatatcaataggaagatttcgtaaagaaacggaggcttttttgtgaaagatcgttttgagttagtctcgaaatatcagccccagggagatcagccgcaagcgattgagaagcttgtcaaaggcatacaggaaggcagaaaacaccagactctcctgggtgcgacagggacgggcaaaacctttaccgtgtccaatctgattaaagaagtgaacaaaccgacactggtcattgcccataacaaaacccttgccggacagctgtacagcgagtttaaggagtttttcccgaacaacgctgtcgagtattttgtcagctattacgattactatcagccggaggcgtacgtgcctcaaacggatacttttatagagaaagacgcaagcattaatgatgaaattgataaactgagacattccgcgacatcctctctgtttgaacggagagatgtcattattatcgcgagtgtgtcatgcatatacggcctcggttcgcctgaagaataccgggaaatggtcgtgtcgctcagaccggaaatggagattgagcggaacgagcttctgagaaagcttgtggatatccagtatgcccgcaatgatatcgactttcagcgcgggacgttccgcgtgcgcggagacgttgtggaaatcttcccggcttcccgtgacgaacattgtatcagagtggaatttttcggagacgaaattgagcggatcagagaggtcgacgctttgaccggagaaattctcggcgaccgtgaccatgtcgcgattttcccggcttcccacttcgtcacccgggcggaaaagatggaaaaagcgattctgaatattgaacaggagcttgaggagcgcttgaaagtgatgcgcgaaaacggcaagctccttgaagcgcagcggcttgagcagcggacgaggtatgatcttgaaatgatgcgggaaatgggtttttgctcagggatcgagaactattcaagacatttgacgctccgtcctcctggttctacgccgtatacgctgcttgattattttccggacgattttatgattgtcgttgatgaatcacatgtgacgattccgcaggtgcgcggcatgttcaacggtgaccaggcgagaaaacaggtgcttgtcgatcacgggttccgcctgccgtcagcgcttgacaaccgtccgctccgattcgaggaatttgaaaagcatatgcacaatatcgtgtacgtgtcggcgactccgggaccgtatgaaattgagcatacgccggaaatgatcgagcagatcatcagaccgacgggactcctcgatcccctcattgacgtccgtccgatcgaaggacagattgatgatctgatcggcgagattcaggcgaggattgaacggaatgaacgcgttctcgtgacgactttaacgaaaaaaatgtcagaggatctgaccgattatctcaaagaaatcggcatcaaggtcaattatctgcattccgagattaagacgcttgaacggattgaaatcatccgtgatctccgcctcggaaaacatgatgtgttaatcggcatcaacctgctgagggaagggcttgatattccggaagtgtcacttgtcgccattctcgatgcggataaagaaggcttcctccgttctgaacgttcgctgattcagacgatcggacgggcggccagaaacgcggaaggccgcgtcatcatgtatgccgataaaatcacgaattcgatggaaatcgcgattaatgaaacgaagcgccgccgggaacagcaggagcgctttaacgaaattcacggcattacgccgcaaacgatcaataaggaaatccgcgatgtgatccgcgcgacgcaggccgctgaggataaagaagaatataaaacaaaagccgcgcctaaactggcgaagatgacgaagaaagaacgccagaaagtcgttgagcaaatggagcacgaaatgaaagaagcggccagagcgcttgatttcgagcgggcggcagagcttcgtgatttactgttagagcttaaagcggaaggatgatgaacacatggcaattgaccggatcgaggtgaaaggcgcaagggcgcacaatttaaaaaacattgatgtaacgattccccgggatcagctcgtcgtcgtgacggggctgtccggatcgggaaaatcatcccttgcctttgacaccatttacgcggaaggacagaggcggtatgttgaatcgctttctgcctatgcgcgccaatttttagggcagatggataagccggacgttgatgcgatcgaagggctttctccggcgatcagcattgatcagaaaacgacaagccgcaatccgcggtcaaccgtcggaacggtaacggagatttatgattatctccggctcttatacgcgagagtcgggaagccgcactgcccggagcacggcattgaaattacgtcgcaaacgatcgaacagatggttgaccggattcttgaatatccggagcggacgaagcttcaagtgcttgcgccgatcatctcaggcagaaaaggcgcccatgtcaaagtgcttgaccaaatcagaaagcaaggttacgtaagggtgcggattgacggagaaatggccgagctttccgacgatattgaacttgaaaaaaacaaaaagcattccattgaagtggtcattgaccggattgtcgtcaaggaaggggttgccgcccggctttccgactcactggaaaccgcgctccgcttaggggaaggccgtgtcatgatagatgtcatcggtcaggaagagctgatgttcagcgagcatcacgcctgtccgctgtgcggtttttctatcggggagcttgaaccccggctgttttcgtttaacagcccgttcggcgcctgcccgacttgtgacggtctcggtttgaagctggaagtggaccctgagctcgtcattcccaatcctgaactgtcattaaaggaacacgccatcgcgccgtggacgccgatcagttcacaatattatccgcagctgcttcaggcggtctgccgccattacggcattgatatggagactccggtcaaagacctgccgaagcatcagcttgataaagtgctgtacggcagcggcaatgaacggatctactttaaatacgagaatgatttcggacaagtgcgcgaaaatgaaattgaatttgaaggtgtgctgcgcaatattgagagacggtataaagagacaagctccgattatatccgtgaacagatggagcagtacatgtcacagaagccgtgcccgacgtgcaaaggctaccggctgaagaaagaagcgcttgccgttttggtcaacgggcgccacatcggcaccattaccgagctttccgtcggcgatgcgctggaatttttcaaaaacctgacgctgtctgagaaagatatgcagattgccgatttaattttaagagagattgtggagcgtctcagctttttagataaagtcggtcttgattacctgacgctgagcagggcggcgggaacgctgtcaggcggagaagcccagcgtatcaggcttgcgacgcagatcggctcccgtttgtcaggcgtcctgtacattcttgatgagccgtccatcggccttcaccagcgtgacaatgaccgtctgatcagcgcgctgaaaaacatgagggatctcggcaatacactgattgtcgtggagcatgatgaagatacgatgatggctgccgattacttgatagatatcggcccgggcgccggcattcacggcggccgcgtcatatcggcggggacgcctgaagaagtgatgaatgatgcggattctctgaccggacgttatttgtcaggggctcaattcatcccgatgcctccggagagaagaaagcctgacggccggttcattgaaatcaaaggcgcttcagaaaacaacctgaaaaaagcgaacgccaaattcccgctcggcacttttacggcggtgacaggtgtgtccggttcgggaaaaagcacgcttgtgaatgaaattctgcataaggcgcttgcgcaaaagcttcataaagccaaagcgaaaccgggaagccataaagaaatcaaaggccttgaccatcttgataaggtgatcgacatcgaccaggcgccgatcggccggacaccgagatcaaatccggcaacttacacgggtgtgtttgatgatatccgcgatgtattcgcgcagacaaatgaagcaaaggtgcgcggctataaaaaaggccggttcagttttaatgtaaaaggcgggcgctgtgaggcctgccgcggcgacggcatcatcaaaattgagatgcacttccttcctgacgtgtacgttccgtgtgaagtgtgccacggcaaacgttacaaccgggagacgcttgaggtcacatacaaaggaaaaagcatttccgacgttctggatatgacggtggaagatgctctgtctttctttgaaaatatcccgaaaattaaacgcaagcttcaaacgcttgctgatgtcggacttgggtatgtgacgctcggccagccggcgacgacgctgtcaggcggagaagcgcagcgcgtcaagctagcttccgagctgcataagcgttccaccggccggacgctgtatattctggacgaaccgacaacagggctccacgttgatgatatcgcaaggcttttggttgtgcttcaaagactcgtcgataacggtgataccgttttggtcattgaacacaatctcgatatcattaaaacggcggactacatcgtcgatctgggacctgaaggcggagcgggcggcggcacgatcgtagcctccggaacgcctgaagaagttgtcgaagtgaaagaatcatatacgggccgctatctgaaaccggtaatggaacgcgataaaaaacggatgaaaacattgctggccgaaaaagaaacggcagccacgtaatagatcaataaaaacagcccaaaactcatcggttttgggctgttgttgttacaggctttttttctgttggggaagctgtctgcttaaatgcattaagtcctgcagaatatgggtgctgctgctgtccagcagcacttttatatattggatatcatgggaaatgggaagaggggctgctttgatctgttctaattcagccagcatttcgctgttcattcttttctgttcgcgaattaaatttcgaagactctcttccgttacttgggcgttttcgggatctttctccatttgtatgtcctccttgcatacggtcaggctttgttacatattgtaatcggttcggggaaaagattctatagtgaaatctctgaaaccaaaaattacgtataacgaagcatgtccttagcatgaaaatgaaacccgctcattcgtcatacgtatgtataaggaatggttttttatatcatggcacagggagtgtttttattgaaccgaaatcaagcgattatcgcatcaatctgttatttcagcgtgtttctcgcgccgctcattcttccgattgtggcttactttgtcgtcgatgaaaaagagacgaagcggcatgccatgcgcgctctgatttcccatatcattccgtttgcgggcttgctgattgtgaccgccggtgttgtcggcggattgattacggcccagggggagagtatggtgcccgtttttgttatgataacaggagcagctgtttattttctgatcctcatcggaatggtcatttggaatatcgtgcagggaattaaggtgttacgccaggtgtaagaaaagtcgggggaggagttttgtatgaaacaggagaaagaacggattttaaagcttgtggaagacggcatgctgacggcgcaggaagcactgacgctcattgaaaaactggatcatgaatataaagaaaaagaagatcagatcaccgcattatctgcggaggttcaggaacctgcggaagatttcgaaagcggtgcaaaaggaagccaaaagccgtcgctcggggcgaagctgttcgactggattgattctgccgtcaaaaaagtgaaggaagcggatcttgatctgaatttcggccacgcacacgaagtgcagcatatttttcaatttaaagacagtgaattctcggccattgatatgcagattgcaaacggcagcgtcaatatcgtgccgtgggcggatgaagatatcagagcggagtgccaggcgaaagtgtaccgggcggacagtcaggaggcggcgcgcaccgcatttcttcagcatattgagtgtgaagtgaagggcaataagttttttgtccgcacggaaaagaaaacgatgaaaaccaatgttacgctttatgttcctcagaaagagtacgataagataagagtgaagctgtttaacggaccgatcagaggggaacatttacatgtaaaagaattctcggcgaaaacgacaaacggcgttctgtcattctctcatttgacggctgagaaagcgtcggcggaaacggctaacggacaaatcaagctggccggacatcaatgcggcgcgattgaagcggaaacgatcaacggcttgattgatttgcgcggatcgagtgaatccattgacgttcaaagctttaacggcaatatcatgcttaccgtgacagcgccgcactgccgctccatctacacgaaaacgacgaccggaaacgtggagatcgccctgcctgatgattcggcggtgaaagcggagctcaaaagcaatctcggctctctcagccatgagctgattgatgcggaaattttaaaggaaaagaatgataccattcaaaaagaactgatgctggcatcaaatcaaggccatgatcagcatctctcgattttctcagaatcgttaacaggagccattaagctcaagcatactcagaggtgattggatgaaaagactttaccgttcagaaaaaaaccgtaaaatcgccggcgtcgtcggcggtttggcggagtacatcaatatggatgcgtcgcttttgcgcattatcaccgttgtattagcgcttgtcacgagcggaatcgtgccgattgtatatattatctggtgttttgttgtacctttagaaggagatttgaaataaatgatcaaatgggcagtcagcattttagtaaatgctttattattaatcgttatcgcgggatattttgattccgtccatatcagcagtatcggagcggctgtcatcgccagtgtgattctttctgtgttaaatgtgctgatcaaaccgatcatcgtcatattgacattgcctgtcacggttgtgaccctcggcctctttctgtttgtcatcaacgccattacgttaatgatgaccgcagccttgatgggagacagctttcagattgacgggttcggcaccgccatttgggcatccgtcgtgctgtccgttttccacttgctgatccaaaaaggcatattggagccgcttagaaaaggataaaaaacaagctgtcccgagagggcagcttttttatgtgcggtttacataagcggcagcctcctgacgcaacataatgcatagggaggtaatgagatgaaacttgtgatgacgctcttttttctgattggtttgctttgtgtgagtccttctgcggatgcggcgcgcaaagaatcggcaatccccgtgaatcagcaggaattcggacagccgcctcattacataccgcttctggagaatcctccccaaatcgaagtaaaggcggaaatgaaaagaaacctgttcatacaggctcatgtacggaatgctgactatcaagcgttttcggcgtttcttttttataaacaaagcaatgagctggggtttaagatggtgccgatggagcccgcgccaggcgcaatccggctttttacggcccaggtttcaaaacgggatatctggaatggagaattggaatattacctcgttttcaccaacggcagacagcgggcggaatcggagaaaaagcggctgaagctggacggctatcaagccgatttgaatcatattcccgagctgatgattacggagcttgcggttgatacgaaaaatgaagatggcgctgatgcctatgaatttatcgaggtgtataacacgacggacaggcccattcattttaaagactatcatatccgctaccgctatccgaaggaagggccggaatcagatatgatatggaggccgaaagaggataccgtcattccgtcaggcgggacttacgtgttttggctgagacgcgccgcatcagaactgacgatagatgatttcaaccgctattacgggacacgtctgaaggaaggagaacatctcgccgtcatcgaagggacagacggaatgtccaacggccgcccgcgtacggtcgtgctgtcggcaaataccggcaaggatatcgcctcagcgcaataccggaaacacgctttccgccggctgacttctttgctgtacaaatatccgctgaacggaacgggagaattgctgaagatctccacgagcgagcataagccgtcaccgggctccgtttttcaggcgcagattccgcagcagaaaagggtgatcaaacccgacaaggaaaaaccggtcatcgaagaccttacagacagaaagcccgtccggcccgctgaaagcattgaattaaaggctgacataaaagacaaaaaccttgtcaaaacagccgcgttttattaccggaccaatgagaaaaaaccattcaaacgaattctggccgaaaaagaccgcaacgacagcttataccatcacattctttattccccggaactgctcggccaggatcagcttgagtattatatcgcagccagtgatggagaaaatgaagcaaaaacgcccgtcaagatgattgacattgaacagacgagcaaatcacacggactcagaatgaatgttgaaccggaagatacgatatccggcacctatctgctcaaagcgacttccgacgtcagcgccgataagatcaagctgtggattgacggcaagcggcaggagacccggccggcgctggaaaaagaggtctatttcgccttcgatgcccggaaaacgaatctttattttcaaaacaccgtcatgatggaaaacgaggtgctgcacatttttgacgatccgtctcaccgctacagaacgcactcggttctgcttccggaacgtctgctgctaaaagggggcaaaacacagaaagtatccatccgttcgggctcaaaggtttctccgtatgacacgggagagaatcgggatgattttgtcgtgaaacatgcccgtctggtgctttcggacggaacggtgatcaaagacgggaagacggacccgtccgagcagctgtttatcggtgacggcaagcgggcgaatcagcagaagaccttctcattcagcctgccggatcatttgtttacgtcacggctgctgccgtggaacacggcgaagctttcggaaggctatcaccatatttttgtcagtgacggtgaggagcagctgagccaatctgtgagggtggacaattcggggccgaagattgtcccgggtattaaagaaggcgcggcgctgaaaggtaatgttgagctgaatgcggacatccgtgataaatggagcaaagtggaagaggtgaaagcgtttttggacggagaaagcattacgctcccgcatcacacgtcatcagccgatctcaagcccggaaagcacacccttactatcattgcggcagaccttgccggaaatgaaacaacgtccgtccgcaccttccatatcaaacgggaggagccgaaccagccggagcttgccggtcaaaaaatcggcgcccgcaaagcaaagctgtccgtccgggtaaaagacccgacgaaggatgacatgaatgtatcattttatcgcggcttccgttataccgcgcggaatccgggcagcgtgaaagtgtataaacacgcctcattaacggaaccgccgaagggcataaaagaaaatgaaatgccgtttaccctgccggaaatgaaccgtatctcggcaaatgacggaaaaaccgtttcggcggaaagtgtggagcgttttccttatcaccggttcgaagtctccgttgacccgtctatcgacgaaacggatctggccgaggcggtctggaaaggaagctctctgcccggccgaaaggtaaccatgtatatttggaattaccggacaagccgctggcaggaggcggacagcgtccttgccaaagataaaaagccgtttacattaaaagccgccgtttccgcagcggatgtggtgaagaactcaaaaatgaatgtcatcgtgcaggatcaaataccggcgaaaggcaattacacgtttgtctggatgtcggatacacagtattacgcacaagggcacccgcacatttttgacaaaatgacggagtggatcaaagaaaataaggaaaagcacaatattaaatatgtctttcataccggtgatattgtcgatgattcaatggtgatgaaacagtggaaaaacgccgatcactccatgcggacgcttgacaaggcggggattccgtacggagtgcttgccggcaatcacgacgtcggccataaagacggcacataccgaaccttcggggatttcttcgggagccgccggtttgaacagaacatgcattacggcggatcatacaaaaataaccgcgggcattatgatctgctgtcggcaagcgggaacgattttattatgatttatatgggctggggcattacggaacaagagattgactggatcaatcaagtgctgaagaggtatccggaccgaaccgccatcttatgctttcatgagtacttgcttgtgagcggaaatcgaagcccgatcggggagacgatctatcgaaaagtcgtcaagccgaatcgcaatgtggcgatggtattaagcggccattaccataacgccatgaaaaaaaccgatgcgcttgacgatgacggagacggaaaaccggaccgcctcgtccaccaaattctgaccgactaccaggacggtccggaaggggggcagggctttatgcgcataatgcaatttgatcaggccgccaatcaggttcacatgttctcctactcgccgtacacggatgacatcaattactatgacaccgatctgttcgctgataaagacgaattctcagcagaaatggatttacagccgaagaggaaaagggtagcgactgattattttgaatgcaacgtttatacgaacgaactgctcggtcataaaaaacacgtaaaaagcggaaaaaccgcaaattgggtctgggacggcctgcagcctgattccgtttattactggtacaccgtcgtgaaggacccgtacaacggcaaaacaatatcaccgctgtggatgttcaaaacgggaaatacgccgtatcacccggctccggatcagtttgatttcaggcatgcctcaaacccatagcaaaaacatacacctgccgatcggtcagaagaaaatctgacggtcagcaggtttttttctgtaacatgcatggcggtaagtgtttttgacttttttatgtcccttttctatactaaaatcgattggttttcgtaatatgcaggaggaaacataatgaacagtaaaaccgggacaaaagaaagaattattcaaacctctgcatatctttttcagattcagggataccatgcgactggtttgaatcaaattataaaagagagcggagcacccagagggtcagtgtatcatcactttccaaacggaaaagaagaactcgccattgcggcgatcaaatatacgggaagatgcgttgaaaagcagatacagaatagtatgtctcaatccgcggaccctgtagaagcgattcagcactttattcatgtaacggctgaacagtttaatgatccgcagaatattgagggcgtgccggttggattgctggcgggtgagaccgctctgatcaatgaaacgttaagatgcacatgtgttgaggtgttcaagaagtggacggatgtgtttgcggcaaaatttcttgagcatgggtttgaacaagaggaagcggagaagcttgggatgacaatcaactcgatgattgaaggcgcaatcatgttttcattggctcataaaaacaaagaaccgctgctgctgatttcaaagcaggttccgtatattgtccaaaacagaggatagcattttattactcttttctttataaaaatagataccggaaccccagcctcttcgttttgacagagtcatagagaacattcaccggcttgatttgaaaatggcagatcaaaaaaacatctccaacccgtaacggttggagatgtttcatttcaccctgtccatataatgcacgaatgtgtagcggtcgcctctgtaggcggatttgacgtgctcaaaggcagtgccgtcctgcagataagtggtccgcttgatatagaggacgggggcgccgggctggataccgagcagctcagcttcttcctcggaagcggttcccggttcaagctcttgttttgcccgtgagatcggcatctgattgtacgcttcaatatgctcatacatggatgattgaaaatgggaggcatccaattttcccgccttgtcaaacgggatatacgatgcctcaatcgccatcgggatatcatttgccagccggacgcggatgattttatgaagcgttgccggatagccgcaccccaggatagaagataattcttccgtcgcctgaatcagctggtattcggcaagtctactccccggcttcatgccccggcttctcatatcttcggtgaagcttgtcagcccttgaagcggctgttccatcttcagtttgctgacgaacgttccccggcctttctgtctgtataaaaatccttcattcaccaaattggaaagcgcctggcgcaccgtcatgcggctgatgccgaattgttcggcgtattcccgctccgacggaagcagcgcatccgctttcagctcgccgtttttgatttgtgtttttaattgttccataatctgaaagtaaatcggaatcggagattgtttatcaatctgcataggtcaaatcctttcaatcgccgcccgcagccttttcatcaatcaagaccgtcacatccggatgcgcgtgcagggcggaggcggggaatgcttcgctgacgcgcccgtccagaagctgcttcaccgcttgggccttgctttttccggatgccatgatcagaatccgtttgccggacaaaatcgtcccgatccccattgtcagggctttttcagggacttgatcaattgacggaaagtaccgcgcattcgcctgtcttgtctcttcattcagctcaacaacatgggttcgggattcaaatggcgtcccgggttcattaaagccgatatggccgttgtgtccgatgcctaaaagctgtatatccgctccgccgagtgtttgaatcaatcggtcatagcgcccgcattcggcatcaagatcgtctgcccgtccgtcagggagaaagtggcggtcctttcggctgtcgatatgtgcaaaaaaatgtgtattcatataataatgatagctgtttttgtcctcgggagaaagcccggcgtattcatcaaggttgatcgtcgtgacattccggaacgacaagccttctgagcggtgcatccgcacaagttctttgtatacgccttcaggagtgcctcccgtcgcaaggccgagaacggcatccggcttttgtttcactgtttcagcgataatcgctgcggctttttcacttaattcttcataatgtctgcatgtgataacgttcatgtccaatcagcctcccttgagatatatgcggtgtttccgcggcaaatcgtggccagcacgccgcactgtccgtccgtcagaacaacgtcggcgtcttttccttcggcgatgcttcctttacggtcgaatatgccgaggcggcgggccgcatttgccgatgtcatatttgctatatccggccatgagcagtttgtaaacctgcgcatgagcgccgcgccttcattcatttttaaaatggaaccggccagcgtcccgtcagagagaagcgccgtgtccccgcgaacggtgactttttgtccgccgaattcgtattctccgtccttaagcccttttgcccgcatggagtctgtaatcatgatcaggttttggcttcctttcgccaaataggcaagcttaacagccagaggatgagaatgaatgccgtcagtgatcagctccgccgtgatgcggccgcaggcgagagccgtaccgatgccccccggctcacggtgatgaaaggagctcatggcgttaaagaggtgcgtcatatgcaccgccccggcatccgccgctttttgtaaaagctcggctcctgcgtctgtgtgtcccattgaggggatgatgttttggttttttaaataacggatcaggctgaaatcaggatcttcttccggcgcaagcgtcacgattttgatcagccctcccgagagccgctcccatttctgaaagagcccggcatcagcaggagtaatccattgtttcggctgtgctcccgcctttttcggagagacaaacggtccttctaaatgaatgccgatcaactcagcgcctttttgggtctccggtgaggaatacgcccattttttggcgttgatgagcgctttttcaatgttttcgtgctgctgtgtgatcgttgtcgctaaaaaagcggttgttccttcttcgggcagccgggcggacagtgtatcaagagccgcaacatcggcatccatcgtatccgcgccgtatccgccgtgaatatggatatcaatcattccgggaagcgcatacgagccctcgggcgccttccattccttctcatacgtttcttgcggccttgtttttcccgcgtaagaaatgatgccgtcctttataccgagaaaaccgtttcggatgatttctttttctgttacgatgtccgcaccgctgattaacaagctttcagccactttaaaacacgcctttctggttagttgttagttttattttactccttttcagactagttatctagaccagttatgccggaattgtataaatctgttttggttcagacggtaaagtgataaaatataactgttcaaagctcggaacatcccagaacaggaggaacatatcttggcaaaggttcggaccaaagacgtaatggaacagttccatttagaattgatcagcggagaagaagggattaaccgcccgattacgatgagtgatttatcacggcccggtattgaaatcgccggttattttacatattacccgagagaacgggtgcagcttttaggaaaaacggagctgtcatttttcgatcagcttcccgaggaagataagaaacagcggatgaaatcgctgtgcaccgatgtgacgccggctatcatactttccagagatatgccgatcccgccggagcttgtagaagcttccgagcaaaacggcgtgcctgtgctcagatcccctctgaaaacaaccaggctgtcaagcaggctgacgaattttcttgaaagccgtctcgcgccgacaacggccattcacggcgtgcttgtggatatatacggcgtcggcgtgctcattacgggaaaaagcggcgtcggtaaaagtgaaacggcgctggagcttgtcaaacgaggccatcgtcttgtcgcggatgactgcgttgaaatccggcaggaggatcaggatacccttgtcgggaacgcgcctgatctgattgagcatctgctcgaaatcagggggctcggcattataaatgtcatgacgctgttcggggcgggcgccgtcagaagcaataaaagaattacaatcgtcatggaccttgagctttgggagcaaggaaagcaatacgaccgtctcggacttgaagaagaaaaaatgaaaatcattgatacggaaattacaaaactgaccattcccgtccgcccggggcggaatctcgccgttattatcgaagttgcggcgatgaacttcagattgaagcggatgggcttaaatgctgccgaacaattcacgaataagctggcggatgtcattgaggacggcgaacaagacgaataggagttggcaataatatgaatgaagctggaacaccgatcaatccgattgccttgcagctcgggcctttatccgtgcactggtacggcatcattatcggcgcgggcgcgttattagggctttggatggccatgagggagagtgaaaagcgggggctgaaaaaggacatttttattgatcttgttcttttcgccatcccgatcgcaatcatttgcgcaagggcatattatgtgcttttcgagtggagctattactcggaacaccccggggaaatcattaaaacttggaaaggcggcattgcgattcacggcggattaatcggcgcgatcgcaacgggaattgtcttttcaaaagtaagaggcatctcattctggaagctggcggatattgccgcgccgagtattctgctcggccaggccatcggacgctgggggaactttatcaaccaggaggctcacggtggagcggtcagccggtcatttttggaaagtctgcatcttccggatttcatcattaatcagatgtacatagacggacaatattatcacccgacgtttttgtatgaatcgctgtggagttttgcgggcgtcgtgattctgcttctgctccgccgcgtgaacctgcgcaggggcaatctgtttttgacgtatgtgatctggtattcaatcggcagatactttattgagggaatgcggacggacagcctgatgcttacgagccagcttcggatcgcgcaggtcatttccattgtgctgattatacttgcgattattttaatgattttcagacgcatgaaggggtatgccgataagcggtatgctgacacggactgacgactgaaatcggaaaggacataagatgactgataaacatgtaaccgccattttattcgatctcgacggcacgctgattgacacgaatgaactgattatcgcttcttaccttcatacgcttgatcattattgcccggggcagtttaaaagggaagatgtacttccgtttatcggcccgcctctgtacgaaacgttttcaggcattaatgccgaaaagtgcgatgacatgatcagcatgtacagagcattcaaccataaaaagcacgatgagctcgtcacggagtacgaaacggtttatgaaacgctggatgaattgaaaaaagcgggctatcagcttggtattgtcactactaagctgagggatacagtcaatatgggattgaagctgacaggcatcggggcgtttttcgatactgtcgtcacgcttgatgatgtaaagcacccgaagcctgaccccgagcctgtgcggcttgcgctcagccggcttgggtgcgatccgtcggaagccatcatggtcggtgacaattatcacgacgtcatggcgggaaaaaacgccggcacgaaaacagccggcgtcgcgtggacgattaaaggcgcacagacgctttccgcctatgaacccgattatatgctcgagaaaatgagtgatttattgcacatcaccggagtgaagtaatccgtgagaaaaacagaccgccatccggttgcaggtgcaaattcattgtggcatgtttatcagacggttcccttcctgaaggtgatgaaaaatttcatcatcattcagattgcaaggtatacgccgtttttaagcgtgaaaaactggctgtaccgaacctttttgaaaatgaatgtcggaaaacagacgtcattcgcgctgatggtgatgccggatatcatgtttcccgaaaaaatcactgtcggaaaaaacagcattatcggctacaatacgacgattttggctcatgaatatttaatacgtgagtaccggaccggttttgtcacaatcggtgacgaggtgatgatcggggcaaacacaaccattctgcccggcgtcaccatcgggagcggagccgttgtatcagccggcacgctggtgcacaaagatgtccccgccggggcgtttgtcggaggaaatccgatgcaggtgatttatacgcacgaagaaatgaaaaaacgaatggaaaaccccgcagattaacgtcagcggggttttttatgacttgatcacaatggcctggctgcccatctgcttccaggctttttcaaagtcagaccggtctgtttttctgtttttatagccgtaaggatcattaacgtatacataatcgtgatcataaccggttacggctacgctatgcatgctgaacgtaatgtcgatctttccgttcggtgtatcccaagtctgcatatgatcaaccggcttaaaggatgtggtggtaatcacccagaccggccgccctttttcaagctggcggtacactgaagaaatgtcttttcccgtaagatcgtatactttgtttcccgcatattctttggcaagtttatcaatcggctcatgataaacgcctaaacccgggccgttttccatatctccggcaaatccttcattcggatctcccttcagcccgctgctgtatgtgagcggaactttattgattttatccgccaatgtattttttgacacatgatatccggcattgttcaaaatcatggcaaggctggtcacctcacagccattgtacagtctgggagaatccatctgtctgtacagaacgacattcagcggtgacgcgctcccttttaacggtgttttctcatcaggctcgtcggactgctgattgaaaaaatttaaatgaatatcgtttgtatagatgttatatcccagatagacaaggatggctgtcagaatcagcacacataatgttccaagcgtcttcattatcaattattctcccttgtttctgatgaagctgttctatgtattatagcacttctgctcaatatgattcgatcgttccgatatgtttacaggtttgttcattctttagccatgtttatggaaaagaataggcggacattgggcgttgcaatccattcttttatctgctaacatattatcatattagcgaactaaaggattcggaattttccttcagacaaagcggaggtgtaaaaggcaaatgtttatgtttgagaaaccgcatggcatgagagatacgctgcccggtttatacgaagccaagaaaaaagtccgttccacactgacggatttaattgataaatggggttatcagtttatggagacgccgacccttgaattctatgaaacagtaggcgtccagtcagccattgaagaacagcagctgtttaagcttctcgatcaggacggaaaaacgcttgtgcttcggcccgacatgaccggaccgattgccagggtggcggcatctaagctgcacaaacacaatcatccgctcagagcggggtacgcggcaagcgtctatcgcgctcaggagcgggaaggcggacgtccggccgaattcgaacaggtcggcgcggagctgatcggcgacggatcaacaagcgcggacgccgaggtgattgcgctggcggccggcgctttgaaaaacgcgggattgcaccggtttaaaatcgcgatcggccatgccggactcgctgatgagctgtttgtcgaggttttgggcaatgccgagcgggcggatgttctgcggcgctttctctttgaaaagaattacgtgggatacagggaacatgtcaaatcgcttccgctttcttcaatagacaaaagccggctgctcgcacttttggaattgcgaggcgggaaagagatttgcgccaaagcggaggagatcatcggaatctccggacaaagcttaattcaggagctggaagacctgtgggacattcttgaggattacggatgtgccgagcatattcgccttgatctgaatatggtaagccatatgagttattacacgggaattttattcgaagtgtacgcggcaaatgtcggtttcgtcatcggaagcggcggacgctataacaatctcctcggccatttcggcagtcccgctcccgccacgggcttcgggctccgtatcgacaggctgattgaagcgctcggcattcaggaagaaacaagtgaagcggacgccgtgattttcagcaaggagcagcgggcccaggctattttattcgcggaggaagaaagggcgagaggcagaaaagtcgtcctgcaggatctggcgggcattgaaaatatcgatcatatgacaaaatcattcgcaaacgtcacatactttatcggtgccagaaaggaagagaggaatgggtaaggtactcacaatggcaatgccaaaaggacggatattcgaagaagcggccgggttgctgaggcaggccggatacaggctgcccgaggagtttgaagaatcgagaaaactgatcattgacgttccagaagaaaatctccgctttattctggcaaagccgatggatgttacgacttatgtcgagcatggcgtcgctgatgccggtattgccggaaaggatgtcatgcttgaggaagagcgtgacgtgtatgaggtgctcgatctgaaaatcagcaaatgccatctcgccgttgcggggcttcccggggcggattggaacggagtcgcaccgaggattgcgacgaaatatccgaatgttgcgtcgagttatttcagagagcagggcgagcaggtggaaatcattaagctgaacggctccattgagctggcgcctttaatcgggcttgctgacagaatcgtagatatcgtatcaaccgggcggacattaaaggaaaacggtctcgttgaatcagaacatatttgtgacatcacatcgcgttttatcgtcaatccggtcagctaccgcatgaaggatgatgtaatcgacgaaatggcggccaggctggcacgggttgtggaaggagaaacggcaaaatgaacataaccgcagtaaaaagaagcgagcggttttcactgaagcgttccatcgacagcggaaccgaagagcagcggaaaaccgtcagggggattattgaagacgtcagacaaaacggtgacaaagccgttttggcctatacaaaaacatttgacggcatcagcctgaaccaaatggccgtgagcgcagaggaaatcaccgaggcataccgtctgcttgatgatcagctgctggaagtgatcagacaggcgattgccaatattaaagaatatcacgagcgccagctgcaatcctcttggttttaccatcgcaaagacggctcgatgctcggacagaaaataacggcgctcgattccgcgggcgtatacgtgccgggcgggacggccgcttatccgtcttccgttttaatgaatgtcatccccgcgctcgctgcgggagtggaacggatcgttctcgtcagtcctccgggaaaagacggccgcctttcaccgggcgttctggcggcggcgtctgagctcggcataaaggaaatttacaaagcgggaggcgcacaggcgattgccgcgctcgcttacggaacggaaacgatacagcctgttgataagatcacgggccccggaaatatatttgtagcactcgcgaagcgcgaagtcttcggcgttgtggatatcgacatgattgccgggccaagtgaaatcgtggtcctggcagacgatacggcggtgcccaaagaagtcgccgctgacctgctttcacaggccgaacacgatatgctcagttcaagcgtgcttgtcaccgattcacagaagcttgccgaagcggtatcagatgaggtgaataaacagcttcagaccctgccgcgcaaagaaatagccgaagcgtcgatcagggatcacggccgcatttatattacggaatcgatggaagatgcggtggacacggtgaatgagctggcgcccgagcatttagaaatcatgacgcattcgccggaggctttgcttggaagcatcagacacgcgggggcgattttcttaggacgatacagcgctgaaccggtcggcgattattttgccggaccgaatcacgttttgccgacaaacggaacggcgcggttttcaagcccgctgaatgtaacagattttcaaaagaaatcgagcatcatctcttacagccggaaggcatttgaaacgcacgcggacagcatttccgccttcgcgagactggaagggctggaagcgcacgcaagatcgattgaagcgagaaacggaggaatgaccgatgagaaaagcggaacgcgccagaacaacaaatgagacggatataaggctggctttcgaaatagacggagaaggaaaagccgacatcagcacggatgtgccgtttatgactcatatgcttgatttgttcacaaagcacgggcaattcaatttaacggttgacgcaaaaggcgatacggagatagatgatcaccatacgactgaagatatcggcatctgtttagggcaggcttttttggaggcgctcggtgataaaaaagggatcaaacggtacggatcagcgcttgtgcccatggacgaagcgctcgcccaagtcgccgtagacctgagcaaccggccgcaccttgagatgcgcgctgcatttccgcaagcgaaagtcggaacgtttgataccgagctggtacatgaattcctatggaaactggcgctcgaagcgagaatgaatctgcacgtcatcgttcattacggcacgaatacccatcatatgatagaagccgtatttaaggcgcttggcagagcgcttgatgaagcgtcatccattgatccgcgcgtcaagggtgtgccgtctacgaaaggaatgctgtaaatgatcggtgtaattgattacggtatgggcaatttattcagcgtgtcgaaagcgctggaacgcgtcggcgtcccgtatgtcgtatcagaccggccggaagagcttgaaaaagcggatgcttttattcttccaggtgtcggatcattcagtgacgccatggacaatttacgcagcacgaagcttgatcaattcatacaccgtatggttgacgagggtaagctgctcctcggcatctgcctcggcatgcagctcattttcgaagagagcgccgaaaacggctctgcaaaaggacttggtttattagccggaaaagctgtgagactcaaagacagagatgccgaaggaaacaagctgaaggtgccgcatatgggctggaaccggctgacgtttcaccaaacgtctcctttgctttcggaagcggaagaaggcttcgtttactttgtccattcctattatatagacgggatggaagacggcgatcttctggcaagcgctgagtacggcgttcgtgttccggctgtcgtcgggaaacgcaatgttttcggtgcacagtttcatccggaaaaaagcggtacagccggaatggcgatcttaacacaatttacaaaaatggcagcggaacagaaggtgaagaaatgaacgcttttacattatatccggcaatcgatatgagaaacggcaaatgcgtccgcctcatccaaggcgattacggcaaggaaacgatatacggtgactctcctttagacatggcggcgcaatttgcacaagaaggcgccgaatggattcatctcgtggatcttgacggcgcgaaagcaggcaggaaagtaaacgacaggcatgttcttgacattgcgcggcagcttgatgtcaaagtcgagatcggcggcggtatccgttctgaagcggatgtgtacggttatttatcacaaggcgttgatcgcgtcattctcggcagctcggccgtttccgatccggcatttgtgaagagcatgctgaaacaatacggcggcaaaatcgcgatcggccttgatgcaagaaacggatatgtctcgacggaaggctggctggaaacatcctcggtaatggcggccgatctgggccgtgaattggcggccgaaggagcggaaaccttcattttcacggatattgcaactgacggcatgctgtcaggaccgaacatcgaaagtaccgttcagctcgcaaaagcaacgggaaaagacgtcatcgcttcaggcggagtcagctcagtcgccgacctcaaagcactggcccgcttcaaagacgccggcgtatcgggagcgattatcggaaaagcgctgtatacaaaacaattttcattggctgaagcgctcagaagggtgaaggacgcatgatcacgaaacgaatcattccgtgtctcgatgtgaaagaaggacgcgtcgtcaagggcattcaatttctcgggctgaaagatgcgggcgatcctgtcgagctggccgaagcctacgacagggagggcgctgacgaacttgtttttctcgacatttccgcctctcacgaaggccgcaagacgatgacagacgtcgtagaacaagttgcggcaaaactggcgattccgtttacggtcggcggcggaatcaatcaattaagcgatatgaaacgaatgcttcgcgccggcgctgacaaggtatccgttaatacagcggccgttctccgtcccgagctgattacggaaggagctgagtttttcggctcgcaatgcatcgtagcggcgattgacgcaaagtatgacgaagattcggaatgctataaagtgtacacacacggcggcagacagaaaaccgagcgggaagtcacggcctgggcaaaagaagccgtcagccggggagcgggtgaaatcctgctgacaagcatggacgcagacggtgaaaaaacaggctttaatcatacgctcacacagcttgtctcacgtgccgtcccggtgcccgtcattgcgtcagggggagccggcagcgcgcgccatatgcttgaagccttcacagtcggtgaagcggacgccgcgcttgcagcttctattttccattacaaagagacatctataaaagaagtgaaagattatatgaagaaacacggggtgaatgtgagatgaaacaggcagatgaactgcggtttgacgaggccggactgatacccgccatcatacaggatgcggcaagcaaagaagtgctgacactggcttatatgaaccgagaatcctatgaaaaaacgatagaaacgaaagaaacctggttttacagccgttcacgcggggagctgtggcataaaggagcgacatcggggaatacccaaaaggtgaaagccatccgttatgattgcgatcaagatgccctcgtcgtgcttgcggagccctcaggacccgcatgccataagggaagctacagctgtttttccacggaaaaagcagacgcgcaggatcgtttcggcatcttaaatgaactggaaagcgtgatcgccaaacggcaggcggagatgcctgacggagcctacacaacgtacctgtttcgggaaggcgtcgataaaatcctcaaaaaagtcggtgaggaagccgcagaggttattatcgccgcaaaaaaccgcgaccatgaagaattaaaatgggaagcggcggatttgctgtatcatttgctcgttcttctgcgtgagcagtcgcttcctttggatgacgtgcttgacgtccttgcgaaacgccattctgcatctgagtaaaacaaacctcgcggagagacccgtgaggtttttattctgtcaaacttaaacattcaataaaatattccttatttccgcaaccgtaggcagatgaatttgataatattgactaatagagtttattttggtttttatcaaaaatatacgttttgttcatattccgttcatgcacatccgttatagtataaacagtgatataggaggaaaacatatgccgaataaacaaccaaaaccaaaagggaaattcagctcattcttttcattagtcaaaaaaacaaaaccatcatacggtatgctggccttcgcgctgtctctcagtattgtgacaacgctcgtcagcctgctgattccgctgttgacaaagcagctcgttgacggcttttccgtgtcgtcgctgtcaggcgtgcaaatcggaatcatcgcagccgtgttcatcgtacaggccgcattaagcgcctacgccacctacgccctgaactacagcggccagaaaatcatctcgggactgcgtgatttgttgtggcagaaattaattaaactgcccgtctcttattttgacaaaaacgccacgggagaaacgatcagccgtgtcaccaatgacacaatggtggtaaaagagctgatcacaaacaatatcagcggatttattaccggaatcatttccgttatcgggtcactgacgatcttatttttcatgaactggaagctcacattgctcgtgctgatcgtcgtgccgctggctgcggtgattttagtgccgatcggccggaaaatgtttaaaatttctcgggaaacacaggatgaaacggcgagattcaccggattattaaaccacatcctcccggaaatcaggcttgtaaaagcgtcaaacgctgaagaagcggaatacggacgcggaaaagcaggcatcatggcgctctttaaactcgggctgcgtgaagcgaaggtgcagtcgctcgtaggcccgcttattacacttgtattaatggcggcgctggtcgctgtcatcgggtacggcgggatgcaggtgtcatccggtgaattgacagccggcgcactcgttgcctttatcctgtatttgtttcagatcattatgccgatgggccagatcacttcatttttcacacagcttcaaaaatccgtcggcgcaacggaacggatgattcatattcttgcagaaaaagaagaagatatccaaatcggaaaagccattgaaaacgcggatcagccgattaagctcgaacaagtctcattcggctacaaaacagatcaaaccatcttaaaagacattacggctacgattgaggccggcaaagtcaccgcgatcgtcggaccgagcggcggcgggaaaacaacgttatttaagctgcttgaacgattctacaacccgactgcgggcagcatcctgctcggaaatgaaccgattgatgcgtattcccttgagtcatggcgggagcatatcggctacgtgtcgcaagaaagcccgttaatgtcaggcaccatccgcgacaatatctgctacggattaaaacgcgaggtgactgatgaggaactgaggcaagcggctgacatggcctacgccctgcaatttattgaagacttaccgaagaaatttgaaacagaggtcggtgagcggggaattatgctgtcaggcggacagcgccagcgcatcgccattgccagagcgctccttcgcaacccgagcattctgatgcttgatgaagcgacatcaagtctggacagccaatctgaaaaatgggtgcagcaggcgctggaagttctaatggaaggccgcaccacgatcgtgatcgcccatcgtttatccacggttgtggatgcagatcagcttctctttgtcgaacagggtgaaatcaccggacggggcacacaccatgaattaatggcatcccattcgctgtaccgcgattttgcggagcagcagctgaagctgaatgccgacttagaaaacaaagctgtgtaaagcaagactttatgaatagaaagcagctgaaaaagctgctttttattttgcagccggagttctcttcatagaaagcgggggttaaattatgaaaaaacgcacaaagattttttattggcacgcggccttactgctcgtattcatgactgccgggtgtacggacggtaacgatgaagagccgagccattcttcaagtccggccggagaaagcagcggcatcaacaaggctgaaacagcatcagcggcagaaaaaaaagaaccagtaaacaaagattcacatcacatctctgcggacaaaagcctgtcggcagattattctcctctgcaaattgaatatgcccgcatctggctgcagcttggggaaaatcagcagatagatgaattgaacgttcgccgcattccggccggagcactcgtcaaccctgacgatcatacgagcgcccgctatcccgaagatgttacgcagttagcaggctcccggttagtcgatgggtcagtcacttacagcagcaatggtgacggcaccattcagatatacaatgttcctttgcgctgggagtctcgtgaagatactgatcaaggcgtaatgaaagaagtgacggaggaaatgatccgccatacaaaaaaagtgtctgtcgatacaggagacaatgaaaaaataagatggttaatagacatcatgtcgattcattaaaagaagacaggcaaaaaagcagaaggagggatttttatggctgtcatattggttgcggatgacgaccgccatatccgtgagcttgtccgactcatgatggagcagagcggctttgacgtcgcagaagcggaagacggggaagcggcggtgcggctgatcgaatcagcacctattgatctcatcatactggatgtgatgatgccgaaaatggacgggtttgaagtcagtgaagccgtccgcagctttacggacattccgattttgatgctgacggcaaaaggcgaaacgctggacaaagtgcaaggttttacttccggagcggatgattatctcgtcaaaccgtttgagccgcttgaactggaagcaagggtcaaagcattgctgaaacggtaccggatcaccgctgaaaaactgctgaccatcggaaatgtcacattagataagcaatcccgcaccgtaacgcgcggcggcggagcgggattgacgctgccccggcgtgaatttgagcttttatttaagctcgccggttatccgaataagacgttttcaagagaacaattaatagaagatatttggggctttgattatgaaggtgacgagcggacggttgatgtgcatgttaaaaggctgagggaacggtttccggaaaaggactatccgtttgctatccatacggtgcgggggctcgggtatcggtttgtggtgacagaatgaaacggatcttcagaacggctggaaaaatcatcatccttctcaccgtcaccgcattcttatggctggcggctcatctgatcgttcagggattcggtctcatatggccgattttgcttgtgccgtacgccgagcagattctgacgctctggcttgttttcggcctgctgtttataacgatgtttatcttttcaaagtcagcacgtgaaagacatcatgcgatctgggattcactgaccgccacgatcaagcaaatgtcgagcggcaacttcacagcggccgcctccaggaaaatggagaagattgaacgggaccaccccgtgacgaaattggctgatgaactgtcgacactcgccgcggaactgagtgaaatggaaaagctgaaacaagaatttatttcgaacgtttcccatgaaatccaaaccccgcttacttcattaaagggctacgcgcacctcctgaaaaaaccggatttatcatatgaggagcgggggcgctatttacacatcatcgagacagaaacagaacgattatcaaaaatcagtgaaaatctgctgaagctcactgcgcttgaacgccaaaccgaaccgatacaaaaaaaaccgttccgcattgacaaacagctgcggcgcaccatattgacctgtgagcctgaatggtccgccaaacagattgagtttctcattgatttacaggagtcgtatgtgtacggagatgaagcgctgctcagccaagtatggatgaatctgattcacaatgccgtgaaatttaccggtgaaggcggccgcatttccgttaaaattgttgatctgccgggagcggcggctgtcgaaatcgccgacgacggaatcggaatggagcctgaacaggcggagcgggtatttgaacggttttataaagcggataaggcgagaaacgcagggggaagcgggctcggcctgtccatcgcccaaaaaatcgcagagctgcacggcggttcgatagaggttgagagcaagcgcggcgaaggaacccttttccgcgtcattcttccagccgagcctcgtgaaaaaaacagctaaaatctggtcgaaccagccagtaaaaaacgaagccgatcctgtcttttgaactattgaggcgaaaccgttttatggtatactactgacggtaatacgtataaaacggaggatatttgtgggaaaacacacttctgaacagaaaaagcacgcgcaaattgtccagctgcttcaggatggacaatatttttttcataaaggcttaaaagcatataaagagcggaatttaaaacgggccagcaaactgattcagcgggccgtccatctcgagccgaatgattccgaaatgctgtcacggctggccgtcatttattctgaaatgggccactaccagcagtcaaatgagctgttcgactttattttggtgaacctgaaagaagaaatgcccgagtgtcattattttaaagcgaataatttcgcgcatttggggctctttcaggaagcatacaaagaagcggaggcttattcagatgccgatccggacggggaattcagcgaagagattgaaaatctgatggagcttttggatttcggcgaagcgggtgaaaacgaatcgctctatgaccaggatgagctgctgatcaggcaggaccgggcaaaaacgcttcttgagagcggccagcttcatgaagcggttgtcatgcttgaagagattacggccgattaccccgagctttggtctgcatacaacaacctggcgctcgcttacttttactcaggcaatgttacaaaagcgaaacagacggtattcgaagtgcttgagaaaaatgaaggcaatctccatgccctgtgcaacctccttgtattctgctattacgagagggaagatgaaaaagtcggagaattgagcggaaaactcgccaacgtgtatccgattttattcgaacagcgctataagctgggggcgacgcttgcgcttgtcggcagacatgatctcggttataaatggctccgttctctttacaaaagcgggttcgaaggcgacgaaacgttttattactggcttgccgcctcagcctacgggacaggccgcacagaatttgcggaaaccatttggaaaaaggccgaagccgaatttcccgaatcagaccggcccgcgccttgggcggagcggcaggaaccgctgcctgcttcacttgaacagcggcttgccgcctattatatcagcagcgctgaaggagagcggaaccagcttgaaaaagttctgacggcaaaacgcgccgtttcaccgtttgaacaagatttcgtcagactgctgctttccggtgaaaaaggcgcttcaggcgtctccggtgacgcgctgttcacgtatcggacggtcaagcttctggagaaagcggaagccgacagtttaaaaactgacgtcatgagctgctgggtttttcacgtcattcagcacatccgcgccgccgctgccgtacagaatgagcgggcatgggccgcagccatcgcatacgtatggaaagaagcaaacggcgaaaaaacgacgaaaaaagaaacggccgccgtttacggtataaccccggcaaccctttcgaaatacatcagacaaatagatgatatattagaataaaaccgattctttctatataaagagtcggttcttttttttattataaaggggcaaaacagaactttaccgccgaaaaaagaggtattcatacgtatttttttgctttttgaatcgaaatcaggccgtaatcaccgtttattttgcaaaatatgagatttgcaatcacattgaaatataactgtaataaaaattgtcgaaacatgatggtataatgagtctcgtacataagagattagtttattttacatgtgctgtataatctataccaattaaccagattcaaagaatcgtacataaaaatcatcagcctcacgggcatgtgagggagcgtaactttgatgttcataatagaattccaaatgagaacaggtttaaagtaaaagggaggaaagaaaaagtgaaaaagagtttattaacacttggtttggcttccgtcatcgggacaagcagttttttgatcccgtttacaaaaactgcatcggcggaaacattagacagcaaaaaagcgaaaattgaaagcaagcaatctgaggtggcttcaagccttgaagcaaaagaaagagaattgtccaagcttcaggacaagcaggctaagattgaaaaagaactgaaagacattaacgctaaagcgttggatacaagcaataaaatcgaagataaaaaagctgaaaacgaaaaaacgaaaaagcagatcgctgatttgaaaaaagaaatcaaagaaacagaagcgcgtattgaaaaacgcaatgaaatcctgaaaaaacgcgttcgttctttacaggaaaacggcggttctcaaggatacatagatgtacttttaggggcgacaagcttcggagacttcatttcccgtgcgactgcagtatcttctatcgttgatgcggataaagacctgatcaaacagcaggagcaggataaagcgaaactcgaagacgcagaggctgaacttaacgtgaagctgaaaaaagttcaagatgatcttgcgaaactcgagtctatgcaaaaagacctgaacaaacagcttgatcagaaagacaagcttttcgacgaagcgaaaaacggtcagaaaaaagcggcttccgctatctctgatctgaaaaaagaagcgtcacagcttgcaaaccaaaaagctgacactgaaaaagagcagaagcgcattaaagctgagcaggctgcagcggctgccctgatcaaaaaacaggaagaagcgcaaaaagcttctgaagaccaaaaccaaaaagatgacagccagccggcaccggcggttaaaactgtgaaaaaagcggctgtttcaacatcatctgattcatctgacagctcaagcaaaccgaagagcacttcaggcggatcatctcataacagcggcggttcagatgattctgacggcggatctgttatttcaaattcaggcggtattgaaggcgcgatcagcgtaggatcaagccttgtgggtcaatctccgtataaattcggcggcggacgcactcaatccgatattgacaaccgtatctttgactgctcttcattcgtacgctgggcttatgctaacgcaggcgttaatctcggacctgcaagcggcacaaacacagatacattaatcggaagaggtaaagcagtaagcgcgtctgacatgaaacgcggagacttagtattcttcaacacgtataaaacaaacggccacgtcggcatctacttaggtaacggaacgttcctgaacgataatacatcacacggtgtatccattgattctatgagcaacccttactggaagaaagcattcaacggcaatgtaagacgtgtcgtgcaataatgaataagacaagggccttctatcccggaaggctctttctttatttgtatacccgctcaggagctccctaatcacggtttctcagaaaaatgagcaaaaaaatagcgaattgccctcagatttaataggatatgggtaaggaatacgattgatggggattcttagtcatatagggtgcgccccatttcgaaaaggagtgaatcatggtgtcagaagaaaaaatttatgatgtgatcattatcggcgcgggtccggcggggatgaccgctgctgtttacacatcacgagcgaacttatccacattaatgatcgaaagaggaattccgggcggccagatggccaacacggaggatgttgaaaactatccgggttttgaaagcattctcggccctgaactttctaataaaatgtttgaacatgcgaaaaaattcggtgcggaatatgcgtacggcgatattaaagaaatcgtggacggtaaagaatataaaacggtcaaagccggttcaaaagaatataaagcgcgcgccatcgtcatttctgccggagcggaatacaaaaagatcggcgttcccggcgaaaaagaactgggcggccgcggcgtatcgtactgcgcggtttgtgacggcgcgttctttaaaaataaagagcttgtcgttgtcggcggcggagactccgccgttgaagaaggcgtctatctgacacgcttcgcttcaaaagtcaccatcgttcacagacgtgacaaattgcgtgcgcaaagcattcttcaggcgcgtgcctttgacaatgagaaaattgacttcaaatggaacaaaaccgtaaaagaaatccatgaggaaaacggaaaagtcggcagacttactcttgtggataccgtgacgggagaagaggaagaattcaaagctgacggcgtctttatttatatcggtatgcttccgctttctaaaccgttcgaaaacttgggcatcacaaatgaagaaggctacattgaaacaaatgcccaaatggagacaaaagtcccaggcattttcgccgcgggagacatccgtgaaaaaacgctccgccagatcgtaacggcgacaggcgacggaagtattgcggctcaaagcgttcagcattatgtggaagagcttgaggaaacgctcaaaaccgttaaataatcactgtaatgttcagtttttgaatcgttactgtgttttaattacgctgtaacacgggtgaaatactgatgttttaagatgaatgtagtaattgaccccctttttaatgaatacactttggcacggattccagtatccgtgccctttttttgcgattttttgttttctgtcaaataaaagaaaaggatgtcggtgtctctgcattgtgagagacatgccgaaacggtataatgaagagacgatgatttgttgagaaggttaggtgacgtacttgtgcaaagagtgacaaattgtgtgctgcagacagatgatcaggttctccttctccaaaagccgagacggggctggtgggtcgcgcccggcgggaagatggaaagcggcgaatccgtcagagattccgtcatcagagagtacagagaagagacgggcatttatatactaaatccgcagttaaaaggcgtgtttacctttattattaaggaacaggaacaaatcgtgtcagagtggatgatgtttactttcgtcgccgactcctacacggggcggaatgtcgctgaatcagaggaaggcgttctgaagtggcatgacgtaaaagatatccacagccttccgatggcccccggagacgggcatatccttgattttatgatcaagggccaagggcttttgcacggcacctttacgtatacgccggacttcgagctgctcagctatcgtttagatccgcagcttatcaaataaaagaaagaccgcagggggggagaaagatgagtatgaatgaaaaccatgatattcagctcgtcatcattacgggaatgtctggagcggggaaaaccgtcgccattcaaagctttgaggatctcggctatttttgcgtcgacaatctgccgccttccttgctgccgaaatttttggagctgatgaaagaatcaagttcaaaaatgagcaaggtcgcgcttgtcatggatctgcggggacgtgaattttttgacaggctgattgaggcgctggatgaaatggcggaaaatccgtggattacaccgcgcattctctttttagacgctaaggattccatccttgtgacgagatacaaagaaacgaggcgttctcacccgctggccgctaccgggcttcctcttgaaggaatcgcgctggaacgccagctgcttgaagaattgaaagggcgctctcagctgatctatgacacatcggatatgaaaccgcgtgatctgcgtgaaaaaatcgtggcgcatttcgccacgaaccaaggtgaaacatttacagtgaacgtgatgtcattcggtttcaaatacgggcttccgatagatgccgacctcgtgtttgatgtaaggtttctgccgaatccattctacattgaaagcatgaggccgcttacggggaaagatgaggaagtgtcatcctatgtgatgaagtggaacgaaacacaaaagtttattgaaaagcttgttgatctgctcggctttatgcttccgtcttataagcgggaaggtaaaagccagcttgtcatcgcgatcggctgtacgggcggccagcaccgctccgtcacgctcgctgagtatttggctgactattttaaaaaagatttctatactcatgtcactcaccgggacattgaaaagagaagccggaaatgaataagaagccgaaaatcgcaatcttcggcggcggaacgggtctgtccgtgctgcttcgggggttaaagcataagcccgttgatattacggcgattgtgacagttgctgatgacggcggaagttcaggccgtctgcgggatgaacttcaaattccgccgccgggtgacatccgtaacgtactggctgctttgtcagatgttgagccgctcgttgaaaatctgtttcagcaccgtttcaacaaaggaagcgacttaaccggacattcgctcggcaatttgattttggcagcgatgacaaatataaccggtgatttctttcacgctgtcaccgaaatgagcaaggtgctgaatgtccgcggcagagtgctgccggctgccaacaccagtgtcgttcttcacgctgaaatggaggacgggcaggtcgtctccggagaatcgacaatcccttcttacggccagcgaattaaacgggtgtttcttacgcctgaaaaaattgatccgctgccggaaacgattgacgtcatccgtcaggccgatttaatcattatcggtccgggaagcctgtacacaagcattcttccgaatctgctcgtgccgaaaatcggagaggaagtcgtcaaggccgcggccaaaaaagtatatatatgcaacgtcatgacacagcccggcgagacgcttcaatacagcgcggccgaccatgtcaaggcgctgaacgatcatatggagcagccgtttatcgacacgatcttaatcaacaatgaggagatccctgacgaaatcaaaagcaaatatgcgaaagagctggcccggcccgtcgacttcaatgttgaaaagctgaaatccatggggcttgaggtcatcagggatcagattatcacgtataaaaatggcgtaatccgtcacgatacacataaagtggcttctcttcttgtcgatttattaagggactagaggccttttgaaatgaggtggctaatatgtcatttgcatcggaaacaaaaaaagaactgacgaatctggaagtgaaggactgctgcgccaaggcggagctgtccgcgctgattcggatgaacggttccctgtcattttcaaaccgccatctcgtgcttgacgttcaaaccgaaaatgcggcgattgcccgccgcatttatacattgctgaagaaacaatatgatgtatcggtcgaactgttagtcagaaaaaaaatgcggctgaaaaaaaataatgtttatattgtgcgcttttctgaaaatgcaaagctgattttagaggaattgaaaatcctcggggagaactttgtatttgaacggaatatttctgaggaactggtggcgaaacggtgctgcaaacgttcttatatgagaggggcgtttttggcgggaggatctgtgaataatcccgaaacatcgtcgtaccacttggaaatcttctcgctttataaggaacataacgattcattatgcgccctgctgaatgattttcatctgaacagcaaaacgcttgaacggaaaaaaggctatattacgtatttaaaagaggcggaaaaaatcactgaatttctgaatgtcatcggcgctcacaattcactgctgcgctttgaagatgtgcggattgtcagagatatgagaaactcagtgaaccgcctcgtcaattgtgaaacagcaaacttaaacaaaaccatcggggcttctctcagacaggtggaaaatattaaatacattgatgaacggatcggtcttgaagcgctgccggaaaagcttcgcgaaattgcgcagctgcggattgattatcaggaggtcacgctgaaagaactgggggaaatggttgcaagcgggaaaatcagcaaatccggcatcaatcacaggctgagaaagctcgatgaaatcgcagaacagctgcgtacaggacaaagcatcactttgaaataaccgtacagaaaaggggagatcttatggttcaggggaaagtggaagtgcgtttaaagacgggattgcaggcgcgccccgctgcattgtttgtacaggaggcaaatcgttttgcatcagatgtgtttcttgagaaaaacggcaagaaagtgaatgccaaaagcattatgggattaatgagtctggcggtcagtacggggacggaagtcactctgatcgctgaaggcgacgatgaaaaggaagcgctggaaaagttgtccgcttatgtgcaggaagaagtgtaaacactttgtaagggggacggaacgatgaatgagtttctgaaagattgttatcaaacgataggctgggaaaaggattccctcgatttcagcaacctgccggagtttttaaaggcgctcgcgtatcggtttccgtttgaaaaccgcgccgttttgtccaaaaaagaatatgacgtcacgaaagaaggactgtggcggcacatggtgaaggaacctcacggcggtctttgttatgacttgaacggactgctttatttcatcctgaaagatgccggatttgatgtcaaattgatccgcggaacggtctggaaaaacggctgggcgctgcccggcacacatgcggccgtacttctttccgccgggggaaatgagtacatcgctgatgcaggcttcggcctcaatctcgccatgcagcctgtgccgatgtcgggagacgagacggtatcagcggccggagcgttccgcgtgaggatagaagagacggaattcgggacatacgtgcttgaaatgaacaaaggggacggctggcagacaggctacgcattttcgcttgaagaaatcgatgaaaaggacctcaagtctatgaaacaaacaatctttgaacatgaacgttctcctttcaacaaacgcctgcttgcttctaagcggacaccggaagggcacatggttctgtctgaacgcaatataacaataaaaaaacacgatggcacggcggaaaacagcagaatagaccgctcagagtttgaagaaaaatttactgctcattttatatgaagcttgcagattctctgcaaaaaaacggcctccgcagggaagccgttttttgtatgtgtttatctcatttttgtaaaggtttgatagtggtctgtcgtcttataaatcagccagtcgcttgagtaaagaatccggtctgaatttctgaagcctgatgtatagttaatatccgcttcacgccacgtccgtccgctttttacagggagtttgccttccctgtttgagaagatgtccccgccgatgcttttccccggggcgacgtccgccagattcccctttgatgccacccagccgagggcctgtgcttctgattttgtaatgtagttatcaggaagcttgtgataggtctgaagataatccgcaaccccgtcaaacgtgttgataacctgtgcttcagtgtgcgccttgtgagaagatgtatccgtcttggcagccgttgaaaacagcatccccgccgcggagaacagcaccagcaaacaaacggaaatccacgataatcgttttttcaaagcaatacctcccatttttatcatgtgaagctgattccttttcattgtatcagcatcaagagaaaggaatagaaagaattttaaaatagtacttttgatctagcgaaaaataaaccccggctgaaacggccgggatttttcatctcattgaaattccttcgtgaggtttttcggtgtttttccgtatacggcgtcaatcatgttctgtgcggcttgcttgaacatattcaagcggatttttgcggttgctgacccgatatgcggaagcaatgtgacgttttccagctgcaggagcggattatcttcggcgatcggctctttttcaaacacatctaaaccggcgccttttatccagccctcttgcaatgcgcggatgagcgctttctcatcaactgtctttccccgggaaatattgacgaaacatgccgtatctttcatcaatttaaattccctctctcccatcatatgatatgtttcgtcagtaagcggggtaattaaaagcacaaagtctgatgttttcagcagtgtatctaagtcggtatatgtaaccccgagttccttctcggcatccggttttctgctgcggttataatacagcacgtccatatcgaagccgaattttgcccgtttggcagcttgttcaccgattctgcccatgccgataattcctaatgtctgatggtggacatccataccgaaaagagattcctcctcaacggttccccatttgccggcgcggacgaatcgatccaattcggcaacccgtctggcggaagacagaattaatgaaaaagccagatcagcgacagtgtcatctaaggtgtacggtgtatgcgtgccgacaaccccgcgccttttcatttctttaatattaaaattatcatagccgactgaattattgctgacgaccttcagcttcggcgcgtgatccagcaaatcactgtcaatcgccgttccggatgtcagcagcccttcagcatctttcattttttcgtacagtttctcttttggaatggtatcttctttccagatgtcatagcggcaatgctcgtctatcatttgttcgacttcgggcggtatcggtttcgcgatgaatacatagggtttcaacgggcttctcctcctttgtctttcttctctattttattatataagagaagcggtaacgtgagaaataatcaaacgcattacgataaatttctggttcttttgaacttaaaatgaaagaaaaaggaatgtacatgcttgatttctccaaacaataacagaatccgcctatatttctgaaggcaaaatgagcggaaccgctgttttcaaaagctttataggttggtgtaaagataaattttattatttttgaaagatataaatgaatataatctgaatttacagtcaaattatcgtgtctttttttgaaagcgcttttgaggcctttttctgtgctataattccttactgtaagctgggtaagaaggcttgcaatacaatcggatgggagatgaatagaaaaatggtttctttatcaagcattttggagcacaaccagcagtttgtccaagaaaggaaatatgaaccttaccaaacgacaaaattcccgaaaaaaaagcttgtcatcgtatcctgtatggatacaaggctgacggagcttctgccgcaggcgatgggactcagaaacggcgatgccaaaatcataaaaaacgcgggagccattgtttctcacccatttggaagtgtcatgcggagcattttggttgccgtttatgaactgcaggcagaggaagtctgcatcataggtcaccgcgagtgcggaatgtcgggattaaatgcggcttccatattaaataaagcaaaagagcgcggggtggaggacaaatgtctcagccttctgcagcatgcgggagtcgatttggaaacatggctgaccggttttcacagcgtcgaagaaagcgtggcccacagcgtgaatatggtcaggcatcatccgctcttgcctgaagaggtgccggtgcacgggctggtgatcgatccgggaacggggacgctggatgtagtcgttgacggttatgaaacagtcaaaggaggatgcagctgacgatgcaatttaccggcagatatcagggatacaatttgcagaaatttcagaaagacctaatcgcgggaattgtggtcggaattgtagcgattccactggggatggcctttgccatcgcctcgggggtcggtccggaatacgggctttacaccgttattgtggccggaattctgatttcgctgttgggcggctctaaatatcagatcggcgggcctacaggggcgtttgttcccattttatttgccattgtgatgcagtatggttttgagaatttacttgtagccggttttatggcaggcgtcatgctcgtcctgtttggcgtatttaagctcggaaagattatgaaattcgtgccgaagccggtgatcgtcggatttacggccgggatcgcggtgctgattttctcggagcagattgcccattttctcggtctgcgcgatatccaaaagcatgaaagctttatcctcaacattgcggaaataggcaagaagatcggaacctttaatttgtacagcatcctcatcgcgggaattgctttggccattttgctgttatcagccaggctgatgccgaagattcccggcgcgcttgtggccctgcttgtctctacagccgctgcggtcgtgttttttcctgacaaaatggcgacaatcggttctgcttacggagaaattccgcggcagcttccggctttccagcttccggatttctcaattgataacatggtgatgatgtttccctcggctctgatcattgcgcttctcggcggacttgaatccatattatcggcgatggtcgcggacaatatgaaaggatcacggcatgacagcaatagggagcttgtcgggcagggcatcgccaatatggcagcgccgcttttcggcggcataccggcaacgggagcgattgcgcggaccgcaacaaatattaaaaacggcgcagtttctccgatttccggtgttgtccacggagtcaccgtcctcctcgtcctgctcgtcttcgccccgcttgccgttcacgtaccgctggcaagcatggcgccggtattgatggttgtggcttggaacatgagtgagcggagggaagtcgccaatatgatgcggctgaaaaacactgattcattcgtactggcggcaacctttttgctgacggttctgtttgatttaattatcggcgtttctgccggtcttgtgctcgcttttgttttctttatcagaaaaatgagcgaatcaacaagcattaaaacaccgcatgccgcggtcaaatcggttaaaaatgattcgtccgtcagcacatattccattgaagggccgctgtttttcggttcaattgattcactggaatcatcgctgctggagaggcttcaggaaaagccgaagacgcttattctgctgatgaataatgtgcattacatggatacctccgcagaagcggtgctggggaatgtgatgaaccggatcaaacggcataacgggagattgatgatcgtcggattgcaatcacagccgagagagctgatccggaagacggggctgtttcataaaatcgggaaacagcatttctttgagcatcaggacgagataacgggataaattcagatacggcctgtccatgaaaaagcggacgggccgtgtttttattcggtttcaaagcgcttgatcagtttttcctgatgggctttcatcgcatcttctaacgtgattccgtacttatcggcaaggatagccagatttccgaggacgtcacccatttcttcaatcagctcctgcctgcgttcagcctgggttgcgtccttttcatccggccggtctctgccgatttcatatgctcttaccgcccgggcgagctcacccgcttcttccattaaaaagccgattctgataaatggcccgtacgccgtccatcctcgtttttcgtaaaaatctttcgtccattgttctgcttcagccatctgcatgtgaaacactccttatgtcctgtatgattcttattgatattatcatatagagatgggacaatatatagtgtattttgatttattgatgtacatatatagatgcggagatgaaaaaatgaaaaccatttgtgtatttgcggggtcaaacccgggggtaaatgaagagtacaaacgcaaagcggccgaactgggtgaatatatggcggagcagggaatcggccttgtttacggcggttcacgggtcggtctgatgggaaccgtcgctgatgcgttaatggcaggcggcggaaaagctgtcggcgtcatgccgagcgggcttttcagcggagagattgttcatcagaatctgacggagctgattgaagtcagcggcatgcatgagcggaaagcgaaaatgagtgaacttgccgacgggtacattgccatgcccggcggtttcggaacatatgaagagttatttgaagtgctgtgctgggcgcaaatcggcattcatcaaaaaccgatcggactgtacaatgtgaacgggtattttgagccgatgatgaagatggtcaagtacagcatccaggaaggattttcgaatgagtctcatttaaagctgatacatagttcctcccggccggatgagctgattgagcagatgaatcggtatacatacccgattttagataagaaatggcgtgaattgtaaggcagcggtctgaaatatgtttcggcggctgcatctaattcattctgacggaaagttcttttctccttctcatgcgtaccacgcctttcttcgtaataagagatatgtctgagaataagaggcgaatgagactgctgttggggttgaaagaagaacatccatttcctcagaggagatggatgttttgcggtttccagactgtatgcgtttacaacttttgttgcacgaaagtttcttccgatatgaaatcatcctgctgcatcttttgtttttttgaaccgattccaaatataccgactgtcagtgcacaaagaaaccagcagcctgtaaagaataagaaaacacttaaaaatccgtagcctgaatacaggaaactgacgacaaagggaccggctacatttgcaaggcgtcctacgccgtaagtgaggccatttccagatgccctggcttcaaccggatataattccggcgtataagcatatgcgatcgaactgaaagtacgctcaaacatatgcatgagaaatccgcatacgataatgaccatcggcaaaggattgatgccgtaaaagaatccaagcgccataataattaacgataaaacagaaatggcccactttcgatccacacggtcagagatttgcgccgcaatgagagcgcccagcggggcaccgatcgttcccagagtgacgtatacgatagactcatccattgatacgccttctttcaccagaagggtgggaacccacgtgccaaagccttgaattgcaatggtggaagctgcccacatcgtcattaaaacaaaagttcttcctgctaaaggcttttgaaacagcgtccgatatggaacggattttacagcggtttgtctgctttgcagagccggagctggttcaggcagttcacccttttcattttctgcttttgcctccagttcaagcagaatgcggtgtgcttgttcgctttttcctttcgtgtccagccatttcggtgattcttccagttttctggcgatcagcggaaaaaaaataccgaccgcgccgaatagaaagacaaaccgccagccgtaagaggcggacggcacgaccaatttagccacccagccggccgcaggaattccgcatatgccgattgtaatacagattgcctggtatttgcctttagttgcggatgggaaaaattcgctgatatacgtactcgccacaatcgttgtggcgccgatacctaaactcgtaaaaaatctaaaaacaccgagtatttctgggttccaagccagagaagagaggagggagaaggaagagaaaaaggtgacaaccagaattaaaccttttttccttccgaaacggtctgaaaaccatcctccggcagaggcgccgataaacattccgaaataggagacagatgtaataaaagcgatagtatgagtggatatgttccattcctttaaaagtgaaggcgccgcatatgaaaacgtatttaaatcgataaaatcaaaaaagtaagcgaatgaaaggataacgagcactgcttgatgggcccttgaaaaaggcagtctgtttaatcgattagacgcatttacattgatcatctcgtattcctccgtttatctttgacttgtctgaagacggtattaaccaatgtgattgagcgtattcatgctgtaactttgtttagtaaacacatagccttcagagatttttcttgctgtgcgtactactttaatcgttgttccatccggatcaacatctgcctcggtttttaaaataccgcttggatgccccaatcggatcgttctcccggagaatgaaaattcagataatattgtatcttgcaatagcatgccggcagtcgtacataccgcccctgtaatggctaaagcttgatgcggtttttgcatggacatcatacgaatgacaagatccatctcttctgcgtgtctctttatcccttttgtatcgatataatccgctggagatgagattaatgtcagttttggtacggccggtgattttgcagcagcctcatgtctcggagcgaatctgcatttctcggctgcaatcgatcggatcatttcgagcttttccaatatatccggggtatattcatccggaagttctaagccggtaagccccgtgtcctctgcttttacaaagacaagcggattggcgtaatcaataatcgataccgagatatttccatacggggtatcgagaacatcaataggctgaccggtgggaaacagcttaccggtcaccgctccttcagcctggtgaaatgaaagataaataggagaagctgtacctggaacccccggaatagagcagtccccctggtaatgaaatgttccatttctgacttcgacttctgctgcgatcactttttgagtgtttgtatttaaaattctgacttttgtaaccggctcttcagcttgaacgagccctttctcaatagcataagggcctacggcagaagagatatttccgcaattgcctttgaagtcggtaaatttgtcagtcagactgacctgagcaaacgtatactcaacatctgcatcctttctggcggatttcttaataatggctgccttgcttgtgagagaatggccgccgccgagaccgtcaatttgtctctcgtcagggctccccataatgtctaaaagaaaatcgctccataggtttgtatcgtctggcatgtctttttgaagaataaaaacgcctttgctggtgccgcctctcataacggttacaggaactttttccatgctgtctcatccttacatcattttgtgtggataaaaaggtaccggtccctttggaagatatcgtatgataaataaggattataagtaaaacatataatttttataaagttaaataaaaaacttttataataggagaaaattttatagcagaaaaatattttgggggatttcatatggatgaaaaggattggattgtgctcattacattattcgaagaaaaaaatatgacgaaggcggcagagcgattatatatgacacagccggcgttaagttatcggctcaaaaacctggaagcacaattcggagtgcgccttttttataaaagaaaaaaagggatggagttcacttcagaaggtgaacatctggttgattattcgaaagagatgctgcaggagttcagaagagtgaaggatgatatgctcaatatgagccatgaagtcagcggggttctcagattaggagtctcaagcaattttgctcagtataagctcccggcgattctaaaacggttttctgatcagtatccgtctgttcaattccacgtcaatacgggatggagtgcgaaggtgatggatctgcttcatcattcgggggtacaccttgggattatgagggggaattatgattggcaaggagaaaaacaactgctgaatgaagagaggctgtaccttatttcaaaaactgaaatcaacagtgaggaccttcccaaattgccgatgatttattatcaaactgatgcttctttgaaaagtttgattcaaaaatggtggaataaccaatttactgaaccgcctttcattgcaatggaggtagacaggcaggaaacctgtaaagagatggtgaaaaacggcctcggttattctgttgtgccggaaatctgtcttcagccttctgatgaattatacacattggcgctatcctataaaaataatgaacctgtgatacgcgatacttggctcatgtatgattcttcagcgttagaattatctgtcgtcaaagcattcattacttttttgaatgggaataaagcataaaaaaacctgcaagagacatcatctcttgcaggttttttgggcattacttctggtcttccgtattgcgtgtcagcactttatcgattaagccgtattctaaagcttcatcagctgatttgaagttgtcgcggtctgtatcgcgctcaatgacttcaagcggctggccggtacgttcagcaagcactttgtttaatttgtcgcgaagcaagagaatgcgttttgcggcgatttcaatttctgtcgcctgtccttgcgctccgccaagcggctggtgaatcataacttcactgttaggaagcgcgtaacgtttgcctttttctccggctgcaagtaaaaatgctcccatagaagcggccataccgatgcagatcgtggatactttcggtttaatgaactgcattgtatcatagattgccataccggcagtgattgatccgccagggctgttaatgtaaatggaaatatctttttcagggtcttccgcttcaaggaataaaagctgtgacacgatggagttcgcaacgttgtcatcaatcgcagatccaagcatgataatacggtccttcaaaagacgggagtaaatgtcataagctctttctccgcggttcgtttgttcaatgactgtaggtattaaattcataatgctcctccttcaccttttaggtaagtatgtatttacatgatacatttttggtcaataaaggtcaaacaaaacgctgaccaaaatgccaaccttttcttctaacaccatttttcccataaaacaaaaagttcaaacagcaaagtgaaaatgaggatgatcagcgccggagccttgagaaaatgatatggccggagcgctcaaaatagaccgcagtcgcgtcggtacatacggctgaacggtctgactacgttgtccgtccttccaaaagccgtaccggcaaatacgtttccagcggcaaatcatcaaattcgccttcaatttcttttgctaaaatctcgatggctgttttggaaatcaattcgatcggctgctggatggttgtcaagtccggcagaaccgattgaacggtttcagtgccgtcataaccgatcacttttaattgattcgggaggtctttcccccgttttttagcctcggtcatcacggcagccgccatgatatcatcgctggcaaaaattccgtcggtgtcaggctgttcatcgaataatgttgaaataatatcatggtaatgctgataaaagggtacttcatatgtaataggcttccgtccgtgttcatgcatgacgtcttcgtatgcttttcttctgaggtttgccggtgtttcgagttcaatcgggccgttgagatggacgatgtgccggcaccctttttcaatcagcagttcagccgccttttttccgccgtcatagttgtctgagccgacgacgggaatcgtgtccgataagtaatgatcaatggcgacaatcggcagattctgcttgtgataattgagaattccccggttataagtcacggcgatcacgccgtccacttggtttcttatcagcatctccaaatatttttcttccttatcctttcgatgtaaactgttgcaaagcagcagtttgtagcccatggacgtacaaatgctttcaatatgaaaggcgagttcgccgaaaaacgggttgctggagtttgggatgataagtcctattaaattggttcgttttcggaataaagagcgggccagatcgtttggaaagtaattgatttcttccatcgccttgtacactttttcttttgttttttcgctgatatagccgcggttatttaatacccgcgaaacggttgtagatgaaactcccgctattttcgcaacatcatgaatgttaggcttcattcccgtgccctcctgcatactgaaatggcttacaatttccgtcacgcacttattttagagaatcaggctgacatgtgcaaggacattccatgtttctgttttcatataaagagggtgcgttttgtttgattggaataatcagaaaatcatatgtcaaccgattgacatatgaaaccggttgacatacaattctttttgaaagcgctttatttacggagtgaagggaagtgacgggtatggagagatggctggcggcaataaagtgaaagaatcaagcagcggcggaaagtaagcgcttactcggagctcgcatgtatgtgatgaatatgaagaaggaagtatgcggctcaaaatgactattaaaaggtcctattaaaggagcggtgcaaatgaaaagctcaaaaagtctgtattggaaactgagtgcttatttcttctttttcttttttacttggtcttccagctattctttatttgcgatttggttagggcaggaaatcaatttaaacggatcagcgacaggcattatcttttctgtaaacgccgtatttgccctgtgcatgcagcctctttacggttttatctctgacaaattggggctgaagaaaaagatattgtttatgatcagctgtcttctcatattcacgggtccgttttatatctacgtctatgggccgcttttacaatacaacgtctttcttggcgccgttgtcggaggcttatatttgggagccgcttttttggcgggaataggcgcgattgaaacgtacattgaaaaggtcagccgtaagtatgatttcgagtatggaaaatcaagaatgtggggctcgctgggctgggcggcggctgcattttttgcagggcagcttttcaatatcaatcccaatatcaacttctggatcgcgtctgtttcagccgtcatattaacggccattatcatgtccgtgaaaatagaaatgaccgatcatgagaaaaacagagcggaatcggtccggttaaaagatgtggggcggctctttttattaaaagatttctggttttttatgatgtacattatcggggtgacttgcatttacggcgtttatgatcagcagttcccgatctactatgcgtctttgtttccttcagtgtcgatgggtaaccaagtattcggctatctgaattcattccaggtgtttttggaggccggcatgatgtttcttgcgccttttatcgtcaataagttcggagcgaaaaacagtttgattttagcggggtttttaatggctttccgcatcgtcgggtccggaattgcagttgagcctgtaggcatttcatcaatgaaactcatccacgcactggaattgccgattatgctgatcgccgtttttaaatatttggccgccaattttgatacgcgtctgtcgtccgtcctttatctcgtcggttttcaattcgcatctcaggcaggcgcgtcgattctgtcgccgcttgcgggaggattatatgacagtgcggggttccgtcaaacctatctcatcatgggattcgtcgtctttggttttaccgtcatctccatatttactttattgggcccgaaacaaaacagcaggcgtgtccagcgtctgcaaaaaatcggatagagaggatgttacaaatggacagaattcagcaggcggaagaagctttgaaggaagccgagggtaaagtgaaacaaagatatcgattggggtatcatattatgccgcgggcgaattggatcaatgatccgaacgggcttattcagtttaaaggagaataccacgtcttttttcagcatcatccgtatgatgagcattgggggccgatgcattggggacatgtaaaaagtaaagatctcattcattgggagcacctgccggttgccttagctccgggggacgaattcgatcaaagcggctgtttttcgggaagcgcggtcgatgatcatggaagattagcccttatctatacaggacataatataattgatcaagagaaagacctattctatcagactcaaaatatcgctgtcagccaagatggaaccgtgtttgaaaagcttcaggaaaaccctgttattacggaaccgccggaagacagcgcccgtcatttccgcgatccgaaagtatggaagcatcgcgatgtttggtatatggtcatcggcaactcttcaaaagaaaacgtcggacgggtcgttttataccgttcacctgatttgcgtgattgggaatacgcgggggttctcgcccaaagtgacggtaatctcggttatatgtgggaatgtcctgatttctttgaattaggcggcaaacatgtcctgctgatttcgccccagggtatcgaggcggacggcgattcatataacaatttacatcaaaccggctatttaatcggtgactataataatgaaacaaacaaatttacacacggcgcttttaaagaactggatcacggccatgacttttacgccgtgcaaacattattagatgataaaggacgcagaattgccatcggctggatggatatgtgggaatctgagatgccgacaaaagcggacggatggtgcggtgcactgactttgccgcgggaactgactttgcgtgatgatcataaacttttgatgaatcccgtggaagaaaccaagcagctgcggaaaatggaatatcgggaatgtgccggacgatcggtttcagggagttacttggcaaagacgcccgaagacctgcttgaagtccgagccgtgtttgatgtaaacgattctgatgccgaaacggcaggttttaagattcgcggccttgacgaagaagaacttgtgctgacatacaatctaacggataaaaagctgacacttgattgcaccaagatggggaaagacggtgtgagaagggtgcggctggatgcaaacggcaagctggcgctgcgtatctttattgacagatcctcgattgaagtattcgccaatcatggagaaacaacgatgacaagccgtatctatccgaatgaaggcagattggggattgagctgttttctgagaaaggcgccgtaaaggttgaggaattcacctattggacgttaaaggacatttggaaaaaaagctgaaacgggtgattatcgctttttctgaagcggctggaaatgtaccgagccgagggcagtccgcctgaaatacattttttgtgaaaatcaatgccgttaaacgatgcaggattatgcagcgtcctcgtgcagcataatcctgttgtgtataatcaaaaaagagttgctttctgtgcgtttctttattataatataaaggtatctgattgaaaaaacgtgcgctcgtagctcagttggatagagcggtggtttccggtaccacgtctgtcgggggttcgaatccctccgagcgcgtctcagttaagacgataggaaaaacctcgcagatgataaatctgcgaggtttttattttatcttgttttgaaactgttaatgaatgtgtctctgttatgttcggtgccggcaatcagccgcgcactttcactgatccgctgcgcaagagctttttgcgccttgccttcaaagctgttcaatagtgctgaatacacttcatataattcatctttcaatgtgtccatttcgaatgtcggtttcagcgtttggcgcactgtttccagttttgtccccgctgcctgcgtcatggcggttttcagcatctgccgctgcagccttttcttcatcgggtcgtccttgtgttctaaaagttcgtctaatgtcggcattatgtatccacctctatcatcttaaccagtttgcgagcatctggtctttttcctgaaattcgtccgctattttatgtaagaatccgccgatctcttcaaggtccgtgatcgccgcctgcaaagaatcaataaacgcctgctcagcctgtgtgtcgtaaaaaatcggtcctttatcgtaggattgcgcaatatcttcaattgtattggtcacgtcctgtgcttgaagctgatcaaacaagccgtgtccgacttggccgtaaaattccgttttcagctcggcgattttttcatcgtgctcctgataggcgttctgcgcttcttttttcatcgtccgcaaatcctcagtcatggcctgcaccttttcagccagcttctttgcgtttttcggcgttacttttatcgcgtctccgcttccgatcgcaccggccggcagaagagcgccgagatttttatcgaagactaactcatctccgttcggatttgtgatgtttccgtttcggtcaaatatgaaattcgcttcatttaagccgtgtgtatccggatttctcagaatgacggtagtaaagaaataagcgagatttttgccgatctgctcgttcaagttcccatcaagccgctgcttccggctgaactgtgagagtgaggggtttttcgtataaatcgttgtcccgttgtggcggtcatattcgttccaataacccgccccgaccatgtcgtccggattgataattgaccggatgtaaggatcgtatatgccgctgttgatgtctttctgtgtttcctcatcgtgcagtttcacgacggaagggctgttaaacgcgacggcgtacacatcattattcaccgcgctgtattcggcctcagcgccgccgagtgaatggccggttgttgaaataatcgttgatgttccggcatactttttctttacgctgcgtaccagctgatcggcttgatcgatttgcgatgttttcgttatcagcttatactttccggttgtgagcatggcgtcttgagagggcgttccattatattttccgagtgttttcgaggtatcctccgcgtctttttttacaatataatacacttctttttgcggatcattaccgaaaacaatattgccgccgtccgcttttacgccgtcattgatcgggtcttttccgatatcggttcccgcaaaagcgacgaccacgttttcggggttttttgattttatccattttccgtttttggacttgatgccttttgagaatacaaaggcatcaagacccgtatcagaatcctgcttcactttctcaacgtaccaatatgacgtcttacttattttataaggagttttatatttcatatgcagggctaacattttataattgtaagctgcttgactcaaacggtaatattctttatctgtgacatcagagacggttatttcttttccttttggcatatatacatcacctttcttatattgtaaaatagttccgaaaggatgatacgcatgagaaaatacattattatcctaattgttataattatagcagtgggaggttttttcgtgaagcatcaatatgataaacataaaaacgaagaaaaacttgtgattgaggcgcaagatcatatgaggaattacttaaaaaaagactataaaaatgtacaggaagttcacttttcaaaagactacaatatcgatccgacaggcggagttgaagtttcaggctacataaataataataaagaaaaagaattttccggtatatatgatccaacgaacaaggagataggtatttcagtggtcaatgccgaagaaaggtaaaatacccacctcaggatgagtgggtatttattttgtttaattatcttacaaaattcgtgatatgtttctcatacagttcaaacctattcctgagatcaatcgcctctaccgtctcatttgtcgaggtatccccgatattaacggtaaacgcgtacaaatatcatgacaactcaacgacaggaaaacgtcagatcagcattttactcgctttaagttccaatcttaacttgtcagcaacaatcgcgatgaattctgaattggttagctttgcttttgacatgctgaaagtatattcatatcaagttttcgctcatttcgtttacttaagaacgacagttatttataggaagggtttgatttccaaatgaaaaagaaaaagtacataattatccttattttaataattatagcagttgggggactttttatgaagcatcagtatgatcagaaggaaaaagagattgcgttattcgaagaagcccagaatcatatggaaaagtttttaacaatgaactataaaaatgtggataatatccatttttccgatgattaccatattaatccaatgggtggtattagtattaagggttatacgaatggaaaaaaagagtttgaaggtctatatgatccaggcaataaagaaatattatcatatacggttgatgccgaacccaaagaagaatgtaaagataagctttgtacaagataaattagccagctcaatcgagctgagctaattttgttttattgctcttactctatctcctcgacataaaacaaatcttccataggtacatttaatcctcagttaataatgaatagtgttgtgatatcatatcttgtatttgttttaaatctgcttatcgcagcctcagtagaaccaactaaatcagccaattccttctggatttgaattcctttctccttcatcacttcatttaacctagatctaactataactaacgcttataaaaaagtattctcgatcactgatacttgatacgttgatgttttttagacatgtacaacaccccgaggttgatataaatttaatctaagaaaggatgagtttgtgaagagatgcaaaattgccctaatatttgtgataactatagcgtcaggaagtatctacatgaagtaccaccatgattaaaaagaagcagaacaagaactttttatccaagcgaaaaataaaatggaaagttatataaaagctaattacaaaaatataaagcggattacatacattaacaattataaaataaatcctatgggtggtatttccttgaaggggtacttgaatggtaataaggaaaaagaatttttcggactttatgacaaaacgaatgatgaaataggagtttcgtcagtcgatgcagaagagaaacccgaatgtcaggaaaaagaatgtgaatactaaaaagacgctggaataaagaagtactctggattgccgcttatatgatcctctgcggacattaaagaaaaatcttaagaccctaaatgcatcggatgtcaccaccatttttccattccgcgagcttcatcataactgatgggacggatgattctgtgaaaaaatatattattatcttcattatcttaatagcagccggaggttttataatgaagagtatgaatgataaaaatgttcaggctgaagagataaagattgctcaagaacgaatggagaaatttatcaaagcgaattatgaaggcatacataacgttacatttaaagataaatatgaaacagatccaatgggcgggatagaggtatttggctattacaacgatgatacatcaaataaatttgacggtatttatgataaagcaaatgacaagattatgggacacactatagatgctgtgagaaagaaagaatgcagagataaagattgtgattactaagaagacgctcgtctgcgtttttttatagatgagcttaatgaaaaagacaagggtttcggcatgtgccgcccttgtcttttttattgaacactgtaaaacataaccggaaacagctcattatttgacagtccattttaacagcgttacaattaatcatgtaaatagttacatgtttaaacaaacatattgtctcgggaggtgatacgtccttgaatgaaccttctttaaaaaagtcatttatgagtcagtgaaacgcatcattgatcccgagcacgtgtatttccgcactgtgcctgtgtttgaaacaagcaatgaggcatatcagcatctgcaggaccggctgtttatcggggctgcggtcagattgccggatgacattcggttagatatttatgaaattcaataataagatggagagtgagtcaacatggaaaactttatcggaagccatatgatttacacgtatgaaaacggctgggagtatgaaatctatattaaaaatgatcatacgatcgactatcggattcatagcggaatggtaggcggccgttgggtgcgcgaccaggaagtgaatatcgtcaagctgacagaaggcgtatacaaagtgtcatggactgaaccgacaggcacagacgtttccttaaactttatgccgaatgaaaaacggatgcacggaattattttcttcccgaaatgggtgcatgagcatccggaaatcacggtgtgctaccaaaatgattacattgacgtgatgaaagagtcacgtgagaaatatgaaacgtacccgaaatatgtcgttcccgagtttgcggatattacgtatcttaacaatgcgggaatcaataacgaaacattgatttcagaagcgccatacgaaggaatgaccgatgatatccgtgcgggaaaattaaaataagagaaaaaacccggcagcttggccgggttttttgtatccttttacgagagggttttggtcatgataaagtcgacttgtttatcatcccccatataaaaagagtgttctccggtttggacaaaccccattttttgataaaaggcgattgcattttcgtttttttcccatacgcccagccagatgttctttttattgtgtgctgttgcgattttcacagcttcattcagcagatatttgccaagcccgtgtttctgatggctttttcttatataaattctctcaatctcaagagaatcttcccccattttttctgactgtgcttcgttcatgttgacttttacataccccgcaaggtcatgatgataataaacaaaatagaattgagaagacggattggataattcctttttcagctgttcagagcggaatgcattttccaaataagctttcatattttcaggtgaattttgatctttaaatgtatcattgaatgtttcaatgcttatctcccggagctctgttatatcgttaaggctgcacttttttaatttaatactcagggtcatacagctcctttcttcatttatcataccagctgaattttgttgtatttgcaatgaaaataccgtatagtaaacataccgtaattttgttgtatttgcaacataaaataagaaaatgaggacgataaagtgaaatatgttttttatgttttaggaatcatgatcttgacctttggtatttctgtcacgattcaatcagatcttggaacatcgccttttgatgcgcttattgtgggattgtccgtccatgcagggcttaccgtgggaagctgggaaatcatcatcgctttcctgttaatttgctgtaattcaatgttaaaaaggcaaagaccggaattttcagggatgattacggcgttcataacgggaatcgggattgatatgtggcttttttttctgcatcgagtcataacgcctgaactatggtacggaaaggcgggctgttttgcaatcggtttagttgtgatagggataggaaccgcaacctatctgcacacaaatttcgcaccgatcccggttgatcggttaacgctaattgtccgtgatttaaccgggagaagcatctttttttcaagaacggtcatttacttcatatttttcatactggccttgatgctaaaaggtccggtaggcatcggaacgttattaaccgtttgtttaggcgggatcttccttcatttctttatgccgattaccggaagatggatagacggcatattaacagcatctccaaagcaggaaaaaacgaaaacccggtaacggcggtttttacccgattctatcatttttcatttcacccgcatgtttaaggtataataaaaaagggggagggatttttatgagcggtcaaagaaagctcgttttttacggagctgtcagcgcagatggctatcttgcgcgggaaaatcattctttagattggttaatcggaactgaaggtgaagacagcaccgattatgaagctttctatgaatctgtcgatacgatcattatgggcagaaaaacatacgaggaaatattggttttattgcctgaggaatttccgtacaaaggtaaagaatgctatgtgttttcgcggacattgaccgggcgtactgaacatgtgcggtttattcatgaagagcctgccgattttataaatgcattgaaacgccaagaaggcaagcggatttggattgtcggcgggagtgatctgctgcacccggttttggaggaaaaacttgtcgatgagtttatcattcagatcgcccccgttctgctcggccgcggaatttctttgtttaaacccggagaccgggagacaggactgaagctgactgatgtcaggcgttacaaacaatttgcggagttgcattatgaagtgagataaaatgaaatgtatgaacgaaacccagtaaaggttaccgggtttctttttcatgtttgtttttatgttttgaaatggtgtgggccggaccgcatgaaaatcctgcaaccatgataacaacccctatccacctcacggcatagaaatcagtgtcgcgcaggaagataaatgaaactaagataataagcgccccgattataacggcagctgtgccgataatacttgatttctccatatagaaactcctttatgaatgtttggttaacgtattgggttggaatataacatatcaggggtaatgcggaaatggatatgctgcgaagctgactgatgtctgtaagatgaaaatgaaacgccaagggagccggctcccttggcgttttttatgcttgaaacaggatgcggcgttttgctgaatcgggatcactttcgacagcggtatccgtgttgaaaagcaaagtttcgcgtgaatcggtttcatattcaggccaattgaagtgagaggtgttcgggtttccggtttttgcaaaagcgagccatgcggattgaatttgtttggaaagctgttctgcgtcatcaccgagcggctcttgcagcgtctttctcaaagaatcaaagtttccgaacacaaacggcaattccagagcgtgaacggctttatgaaacggcggtgtttcgccatgccaatcaaagcggtacatccagaccggtgcgtgttgcgactgtccttgtgcgaaagcgacagccggccgccagaaaatcagatccgtcatcatatcgatttgtccctttaatgaatgcggatataaatctgccgcttgctcggtgcagttttctccgaggtgataatgcaaataatcttgctgctttttctcggagtgaatgtctgtatcaggggtgaaaaacaaatatgcttcatcacgattggttccgatgatcataggtatgccttctgcggccccgtctgctatggctttcaccggttccgcaggcaatgtggccggatcgatggcgggctgaaacaaaagctgaaaaatgttttgatccagtgagcgccgcactttatccgcagtcttaagcaggtcattaacggaaagctcctgcaattgatcagtgccggcttcatgaataaatgccgccgcgatgtcttttgccatatccgccggcatcgtatgagaggcgccgctttctaaaatggctttatgaaacaggccttttgcgtcaggcattgccataagcgcagcgatgctcatgccgcctgccgattcaccaaatatcgtgacgttatccgggtctcctccaaattcggagatattgtccctcacccagcgcagcgcggcgatctgatcgagcagcccgatattggcggaatacgcgtcatgaatagaagacaaatgtaaaaagcctaacggtccgagcctgtaattgagtgtcacgacaatgacatctccgtcagcggcaagggcagatccgtcgtaaagcggttcgcttccggcacctaaataaaatgccccgccgtgtatccataccatgacaggctttttttcgccctctgaatcgggggcgaaaacgttgaggtaaaggcaatcttcagattgaggcggtatatctccggaaaacgatatggacagcatatcatccggctgcggacaaatcggcccgaacgaatcggcatgttttatgccgtcccaaggtgcgggcggctccggcgctttaaatctcagctctccgacgggcggcttcgcgtacggtatgcccttccatgtgcgggcaccgcggccggcagttcctttcagtgcgccgcagcgggtttgaacggtaagttttgtcatgatttcatccccttttttcttttcattataaacagagatgaaggcatgaagcgaataaaagccctttcatcagcatatcatcagtaacgcttccgttctaaaaatgatctgacttcctgaacggacaagccgagttcttttgcttcctgcatcagcgctttccattcttcaatgttggattcagtcagttttctgttacggtaggatgcgggctccgggcgcttttcagtcagtttgttcgtaaaggtgaacagttcttctttcggcatgcccgactgcacggcctgcacaaggtggatgcgccactcatcttccgtgcctcccatgtgatgcagcatcgtttcggcatcaaaaagctccgtcagatcgacctgcagggtggcggatacttttttcagaaattggatggacggatttgagtgaaccccccgttctatcttgcttaaataagatttagagacacctgcttcaactgctagctgattaatagagtagccttttcttctgcggtataaacgaattattcttccaatcattgtgctgaattctcccctgtatactggcatttttttgttcattataagaaatttttcgttctttataaaatttaaaattataagggaagtgcagtaaataagaggaaaatcatgataatgttctctaaaaagaactaaatggcttaatttgaaattttcaaatttcgaccttttcttttataatccaatcattaacagaagggggcgtttaagcctgatgcaataaggatgaggctgtaattacatgaatgagaatatgagttttaaagagttatttgacattattaaacacagatttttactgatttttatcatgacagcagttgtaacgctgatgacgggatacatccaattccgggtgatttcgcccgtttatcaggcatcgacccaagtgctcattcatgaaacaagcggtgaaaaaaattcgaatctcagcgacgttcagctgaatcttcattacaacaatacgtttcaaacgataatgaaaagcccggttgtgcttgagaaagtgaaacagaagctgcatctttctgagacggcatccgctttaaaagcaaagatcacgacaagcagcgaaaccgattcagagatcattaacgcagcggtgcaggacgagaacccgaaacaggccgccgctatagcgaacacgctgatgaagacatttaaaaaagaagtccgtgacaggatgaatataaaaggcgtcattgttttgtccgaggcaaaagcatcggaaagcccgatggtcaagccttcgcgcatcaggaatatcatgatggcgttcggtgcggctctcatggcgggtgtgacgcttgcgttttttctccactttcttgatgaaaccgttaaaagcgagcggcagctcagcgaaaaaacagacttgcctgttttaggggttgtgtatgacatcaaaaatcagcagacacggtctgatgaaaaacatttcggggagtgaggcgtttgggattcagaaaaaagaaatcaagaaggggactggctcaaatatccgttttacatcacaaatcattggtggctgaacaatatcgcaccattcggacaaatattgagttctcctctgttcagacccatttgcgctctattctcgtcacttcctccgttccgggagaaggaaagtcattcagcgccgccaaccttgccgcggtatttgcgcagcaggaaaaaaaggtgctgcttgtcgatgccgatttacgaaaaccgacgatacacgagacctatcagcttgaaaatgtacaaggccttacgaatgtgttagtcggaaacgcttccctcggcgaaacggtgcaaaaaacgctgattgataacctttacgtcttaacgagcgggccgacgccgccgaatccggccgagcttttatcttcaaaggcgatgggagagctgattcaggagatgtacagccggtacagtctggttattttcgattcacctccgcttttggcggtggcggacggccagattttagcgaaccagacagatggaagcgttctcgtcgtcttgagcggaaaaacgaaaatggataccgtccaaaaggcgaaagacgcgctccagcagtcaaaggcaaagcttttgggggcgctgctgaataaaaagaaaatcaaaaaaacagagcactactcgtattgagcggtgcaggtgatgtctccttacctttatcaacggaggcactcggctctgctgtgggcggcgttttccgccgccttagatgctggtcgtcggtggcggggtgtgaggacgggttaaatgcccaatttatcttaagatgatgcattgttatcggcttagctgttatgtctgtttttacgaaaaccgtatcagctaaaccgataaatgaggaggggaaagattgacttaccggagaagactttcaatgatttttgcattggatacgtatctcgttttactttccgttgttataggatatcaattttttgaggattcttatcacttttatgactccggagcgttgctgctgaccgccgtgaccatgctgatcagccatcatgtatgcgcttttatgtttcaccagtataagcaggtatggacgtatacgggaattggcgagctgcttgatctgctgaaggggatcacgctgtccgcagctgtcacagccgccgtccaatacggggtgttccacacgattttgttccggctgttagccgtcagctggatggttcagctattgttcatcggaggaagccggatgatttcgcgcgtgctgaaagaaacgatcggcaggaagcaaaatgactcttcccgggcgctgatcatcggcgcaggcgcgggaggaacgctgctcgtccgtcagcttacgcagaaaaatgatctcggaatcatgcctgtggcttttattgatgatgatcagacgaagcataagctcaaaatcatgggcctgcccgtcatcggcggaaaagaaagcattatgccggcggtgcaaaggctgagaattcaccacatcatcatcgccattccgtctctttgcacccatgagctccagacgctgtacaaagaatgtgtgcagacgggcgcccatattaaaatcatgccgcaatttgatgagatcctgctcggaacgcaggctgccggacacatcagggatgtgaaagccgaagatctcctcggcagaaagccggtcacccttgatacgagcaaaatttctgacagcatcaaagggaaaacgattctggtcacgggcgccggcggctctatcggttctgaaatctgccgccagatcagctcgtttcttccgcatgaaatcgtccttctcggccacggggagaacagcatttattcggtgcataacgaactgtccgcacgcttcggcaaagaggtgctttttcacgcggagatcgccgatattcaggacagagataaaatctttacgttgatgaaaaaatacgagccgcacgtcgtctatcatgcggccgcccataaacatgtgccgttaatggaacataatccggaagaagccgtcaaaaacaatattatcggcacgaaaaatgtcgccgaagccgccgatatgtgcggaacggaaacattcgtgctgatttcttctgacaaagcggtcaatccggccaatgtcatgggcgcgacgaagcggtttgcggaaatggtcatcatgaacctcggaaaggtcagcaacaccaaattcgccgccgtccgtttcgggaatgtgctcggaagccgcggcagcgtcattccgattttcaaaaagcagattgaaaaaggcggacccgtcaccgtcacgcatccggcgatgacaagatattttatgacgatccccgaagcgtcaagactcgtcattcaggcgggggcgcttgcaaaagggcggcagattttcgttctggatatgggagaacccgtcaaaatcgtcgacttggcaaaaaacctgattcatttatcaggctatacgacagaacagattcctattgaattctccggcatccgcccgggagaaaagatgtatgaagaactgctgaatcataatgaagtacatacggaacagatttttccgaaaatccatatcgggaaagcgatcgacggggattgggccgtgctcatccgttttatggaggaattcagccgtctgcctgaagatgagctgagaaaacggctgtttgaggcgatcgaatcagtacatgaagaagcggccgcaggtgtgtgatgggaggacagaaagatgacgaaaaaagtattattctgcgccactgtcgattatcattttaaagcctttcatcttccgtattttcaatggtttcaggatatgggctgggaggtgcacgtcgcggcaggcggcaatatgaatcttccattcgttgatgaaaagttttccattccgatccggcgctcgccgtttcatcccgaaaatctttctgtttacaggcggctgaaacggctcattcaggctaacggctacgacatgattcactgtcatacgccggtcggcggcgtgcttgcacgccttgcggcgagacaagcgcgccaaaaagggacaaaggtgctgtacaccgcgcacggctttcacttctgcgatggagcgcccctgaaaaattggcttctttattacccgatcgaaaaatttctctcttcttacacggattgtttgattacgattaatgaagaggattacgaacgggccaagcaaatgaaaaaaacagcttgcggcgcgaagaaaatacacggcatcggcgtgaatacagacaggtttcgccctgtgagccgggcagagagtgaacgtctgagagaaaaacacggcttcggcgccggggaatttatcctcatataccccgctgaattaaacggcaataaaaaccagggacttctcattgaggctgcggcactgctgaagaaccgcattccggagctgaaactcgtatttgccggagaaggcgcgatggaagagccgtacagaaaaaaggctgaatcactcggggtatccgacattgtgcggttttacggtttttgccgtgacattcatgagctgattcagcttgccgatctgtccgtcgcctcaagcatccgcgaagggctcggcatgaatctgcttgaggggatggctgccgaaaagcccgccgttgccgcagacaacagggggcaccgtgagatcatcgaagacggtgtgaacggttttctcgtgccggcaggggacagcgcggcatttgccgatcggattgaaaagctgtaccgatccccgggtctgcgaaaagcaatgggacaagaagggcgcaggacggcggaatttttttcagaaacacgtacggtaaaggaaatggcgcacatttacgccggttatatggataaaaaggagaaaagcgtatgaatgcaggagcacaaccgaaaatttccgttatcatgggaatttataattgcgaagagactttagcggagagtattgaatccatcctgagccaatcgtataagaattgggaactgattatgtgtgatgacgcgtcaactgacggaacgtatcagattgcgcgccgttacgcggatcattacagcgaccggatcacgctgattcaaaataagacgaatcaacggcttgccgcttcgctgaaccgctgtctgacatacgcaacgggggattatatcgccaggcaggacggtgatgacatctccaacccgaggagactggaaaaacaggccgctttcttaaacaagcacgcccactatcaagtcgtgggcacggggatgctcgtatttgatgaattcggcgtcaggggcgcccggcttttgccgcccgtgccgaaaccgggaattatggcgaaaggcacaccgttctgccacggcaccattatgatgcgggctgaagcgtacaaagcgcttggaggctaccggtcagtcaggcggacgcggcggatggaggatatcgatttgtggctgcgcttttttgaagcgggtttccgagggtacaatctccaggaaacgctgtataaagtaagagaggacagtgatgcgttcaaaaggagatcgtttacgtattccattgataatgcggtgctcgtttttcaggcatgcagacggctgaagctgccgatttcccattacgcgtatatcgcaaaaccgctcatccgcgccattacgccgcccgcggtcatgaaccgttatcataaaaacagggacatccgccaaaaagaagggcttgccgaacatgactgacaaaccgatgcgggtgctgcacatcttcagcgggatgaacaggggcggcgcagaaacgatgatgatgaatttgtaccggaagatggacagaacgaaggtgcagtttgattttttaacccataggaacgatccgtgcgcttatgacgaggaaattctcgctctcggcggacggcttttttatgtgccgagcatcggcagcacaaacccgattacatttgttaaacaggtcaagcgggtgattcaggaaaaaggcccgtttgccgccgtgcacgcccataccgattttcagtcgggatttatcgcgcttgccgctcgtttagccggcgtcccggtgcggatctgccattcgcacagtacgtcgtggcgggggcgggcgtcgcggcttgccgggatgcagctgtttgttttcagacggctgatcacggcaaacgccacggcactgtgcgcctgcggaaaagaggcgggccgtttcttattcgggaaagaaaaagacgtgcatcttttgccgaacggcattgatctcgacttatttgccggcgggtgcgcggacacagaagctgaaaaaaggaagcggggcattgcagacggccgtttggtgatcggccatatcggccgctttacagaagaaaaaaaccacgaatttctgctccggctggccgctgatatgaaagagcggggcatcggcttacagctgattctcgccggagacggtccgcttcgcaccgatatggaaaatctggcggcgaagctggggcttgatgatgatgtgcgttttatcggcatagaagaccgcgttcatgatctgctgaaaacgctggatgtatttgtcatgccgtctctttatgaagggctgcccgtcacgctcgttgaagcgcaggcctccggggtgccgtgcgtgatatcagacggcataacggaagaagccgatgccgggctcgggctggtcaaaaggctcagcctcaaagaaccgccgggacaatgggcatccgcggttttacgggcagcagaggcggcaaagcctgacggggcgcgtattaaagaaaccctcaggcggctgggatatgacgcgggagaaaatgcgggggctgttatgaagctttacaatatgaattggaaaaaggaacagtaacgaatgattgtatatgtagtcaatatgggaattgtttatatttggtcatggttcgcgaaaatgtgcggcgggcgtgatcaatcgctttcgaccggataccggccgaatcagctcgtcatgctcgttccgctgctatcgctggtattggtctccggtttgcgctacagagtcgggacggattttcagacgtacgcgctaatgtacaagctggcgggaaattacggcagcatttgggagatcttcgggttcggagcgaaaaaagcagccgttgatccggggtttacggctctcatctggctcatgaattttatcacgaaagatccgcaaatcatgtatttcaccgtggcggtcgtgacatgcagctttattttaaaggggctcgttgagttcggccgtccgtttgagctgagtgtatttttgtttttgggcacgtatcactattacgcttcctttaacgggatcaggcagtatatggtggcggccgttttgttttgggccgtccgctacgtgatcagcggaagctggaagcgttatatgtcaatcgtgctgctgtgttcgctttttcattcctcagcgctgattatgattccggtttattttctcgtcagaaaaagagcctggtcgcccgcgattttcggactgtcggcattgtttcttcttatgacgtttctgtatcagaagttcatttcgctgtttgtcgtcgtgctggaaaacagctcgtacggccattatgagaaatggctgatgacgaatacgaacgggatgaacgtcgtgaaaatcgcggtgctgctgctgccgctgtttttggctttctgctaccgggagcggctgcggaagctctggcctgacattgatgtcatcgtgaatttctgtctgctcggcctgctcttcggtcttttggcgacaaaggatgttatttttgcccggtttaatatatatttcggcctgtaccaaatgatcctgatcccttattttgtgaggatttttgatgaaaaatcaaatgcgctgatttatatcgccattattgtctgttattttctttacagttacttgcttatgccggtcgattcgtctgtgcttccgtacagaacgattttttcccggtaatggacactggaggtttatatggaaacacccgcggtcagtttattaattgctgtgtataatacggaaacttatttagaaagatgcttagattcattgctcaatcagtcgctcgccaatatcgaaatcgtggccgttaatgacgggtcaacggatcaaagcccggcgattcttgaaacctatcagaagcgggatgagagaatcagggtcgttcatcagcaaaaccgggggctcggcgcggtccgcaacaagggcatcgaggcggcgcgcggcgaatttatcgcttttattgatgcggacgactgggttgaacctgattattgcctgcgcatgtatgaaaaagcgaaggctgatcaggctgatctcgtgatttgcgaatatgcggctgaatttgcggatacggggaagaccgccgtttcaacgatcgcttcagcgtacgagggccgcccgaaacaacggtacctgaaagatttatttgaaggaagagtcagcggcttttcatggaacaagctgtacaaaagatccatgatcgagcatcatcagctgcgctttccgcttcgtgatgagctggagcacgtggaggatcagtatttcagcctcagggcgcatgttttcgcaggtgcggtctcgtacgtggatcagccgctctatcattatcggattcacttgacttccattgtgcaaagctatcagaaaaagctgtttgactcaggtctcgttctctatcggctgaacgaggcttttttgcgtgaaaacggctgcttacacgaataccggcaggagctggattttttcatcgttcagcacggaacagtctgcctgctgaatgaatggaagcggaataacggcggccggttttctgagaagtggaagaatatcagccggatatgcgctgatcccgtattccgcatgagcctttccaaaacgggaacggcgccgtttgacgccaaacgctcatgccttctgcttttggcgaagctgaagctgattccgttcgtgtcgctggcatcagccgcgtatcagcgggcaatcgagtacaaaatgaaaatcagagggtgaagacatgtcgatacaatctttaaaaatcaatctcgcggaatggcttttgcttaaggtcaaatacccgtcccaatttcatttcggaacgggagcggatggggcggcggggcttacagcggcaagaaaaaagatcattctgacgctgctcccgtcccacgataatctcggcgatcacgccatcgcctacgcaagcaaaacgtttcttgaacgggagtatcccgattttgacattgtcgaggtggatatgaaggatatatacagatcggcaaaagtgctgatcaaaaagcgccaccccgatgatatggtattcatcatcggcggcgggaacatgggggatttgtaccggtatgaggaatggacgcgccgctttatcataaaaacattccggcaatatcggatcgttcagcttccggcgacggctcacttttctgaatcaaaaaagggacggaaggaactgaagcgcgcccgaaaagtgtacaatgcgcatcccgaccttttgttgatggcgagagatgagacgacgtatcaatggatgaagcgtcattttcccggaaaaacagtgctcaaacagcctgacatggtcttatatttggataaaagcgagcggggcatagcgcgggaagggatctacctctgtttacgggaggataaggagagcgcgctgacggctgaggacagaacgatggtaaaagaagctttggccaaagagtacggagagctgtattcctttaccacgacggtcggccggagggtcagccgccatacacgcgaaaaggagctggaagcgctttggaatacgctgaaaggcgcggaagccgtcgtcactgacaggcttcacgggatgattttttgtgcgctgacgaaaacgccttgtgtcgtcattcgttcgtttgatcataaggtgatggaaggctatcaatggctgaaaaacataccgaacatgacattgcttgaacgtcccgaccctgaagccgtaacatccgccgtaaatcggctgctcagcggcaagcatgaggaaggcggttctttgcgaagtgtttattttgccgggctgcgctcgaaaatcagcggtgatgcccaatgaccgcgccgcttgtgagcgtgatcgtgccgatgtataagacagagccttttattaaagaatgcgcggtttctttaacaaaacagacgctgaggaacatcgaaatcattttcgtcaatgacggttcaccggatcagtcaggccggatggctgaacaattcgccgcagaagatgcgagaatccgggtgattcataaagaaaacggcggcctcagctcggcccgcaatgccggaataaaagccgcccgcggccgttatatcggttttgcggacggcgatgattatgtgacggaaacaatgttcgagcggctttatgaagaagcggagaagaaccggctggatatcgccggctgcggttattacaaagaaacgccgtctaaagaaagaacgtatatgccgccgtcccttccgccgggccgcgtcttcacagcggatgaaatgaccgcattgctgacccgcgcgcacgaacatcggtttatttggtatgtgtggcgctatatataccggcgagaagcattgcaagggctgttgttccatgaagatatccggtttgccgaggactctccgtttaacttggcagcgttccgccaagccgcgcgtgtcaaagtgatagacgaagggctgtatatctaccgggaaaatccgcaaagtcttacagaaacaccgtttaagccccgcttagatcacgaactgcaaaagcaatatgcagcgaaaatggctttttatgaggcaaacgggctgacggacgcctgccggagcgatattgatacatatttgtgcaagcatcagattccgatgctgatcgccaacgcatgcgccgccccgcagccgtcacaccagattacggcgcatatcggcagaatcttaacgtatgacatggtaaaaacggccgtgcgcaggacgccgtgccgccataaacagctgctggccggggagcgcgtggtgctcggtctgtgcaaaatgcgccttcctcttcttctgcatgcgtttttcgaacggaaatcgaaagagaaaggcagtgcggaaggagcatgaaatttgccattaatttcggcgccaatgtgacggcgtttttactatcggtgtttttatcagtgtggatgacgccctttattgtgaaaacattaggtgttgaggcttttgggtttgtccatctgacacagaatatcattaactatttctctattattaccgttgcgctgagctcagtcgttgtgaggtttttctccgtcgccgcccacagggggaacagggacgaggccaatgcgtatgtaagcaattatttagccgcgtctgtcgtgatatctctattactcgctgtgccgctcgccgggactgctttttttattgacaggattatgaatgtaccggccgggctcttaacggatgtgaggctgtctatcgtaatcggcagcgtgctgtttatgctgacgttttttatggcggggttcgcgacggggccgttttttgccaacaagctttatatcacaagttccattcaggccgtgcaaatgctggtcagggtgctgtgtgtgctcgctctgtttacgtgcctgccgccgaagatctggcagatccagctttcggcattagcgggagccgtctgtgcagctgtgctgacttttttcttctttaagaaattgattccgtggttttctttcagccgtaaaactttatcattacagacaagcaaagtgctgttttcggccggtgcctggagttctgtcaaccagatcggcgtgctgctgtttctgcagattgacctcatgacggccaaccttgtgctggggccgtctgaagcgggtgtctatgcggcgattattcaattcccgcttctgctcagaagtcttgccgggacgcttgcttcactgtttgcgccggttttgacttcctattattcaaaaggcgatatggaaggtctcctgtcttacgccaataaggccgtgcggatgaacgggcttctcctcgcgcttcccgccgcgttattaggagggcttgccgaaccgtttctggcgatttggctgggcccgtcgtttgtgcagacggcgccgcttttatatattcacgccgcgtatttggtggtcagtctctctgtcatgccgcttttttacgtatggacggcttttaataaacaaaaaacgcccgccgtcgttactttatgtttaggcggactgaatgtcatattggccgtggttctcagcggaccggcacatctcgggctgtacggcatcaccattgccggggctgtctccctcattttgaaaaatgccgtcttcacgccgctgtatgtttcgcatattaccggctttcagaaaaccgcgttttacaaaggcatgttcggcccgttggcggcggccgtatttgcctgggccgtctgccggggtatccggctgttttcaccgcttgacggctgggccggtctgatcgccgcggggcttgccgtatgcataagctatgccgcattcgcttttttcttcatttgtacgaaagaagaaaggcggcttgctttacagaaatgccgaaaagtgaaaggagctgttcagatttgaaggtgaaacgtgtatttgatatagcggccgcgacgctgttattgtgcggcgcgagtgtcattcttctcttcgccatggcagccgtcagatgcgccatcgggtctccggtattgttcaaacagacgagaccggggcataacgggcgtccgtttacgttgtataaactcagaacgatgacggatgcgcgtgatgaaaacggtgtgctgcttccggatcatctgcgcctgaccaaaacgggaaggctgatcagaaaactgagcatcgacgagcttccccagctttttaatgtgctcaaaggcgatatcagtctggtcggcccccgccctttgctgatggattatctgccgctttacacggcggagcaggcgcggcggcacgaggtgaagccggggattacgggctgggcgcaggtcaatgggagaaacgcgatttcatgggaggagaaattcaagctcgacgtgtggtacgtcgacaaccgcacctttcttctcgacttaaagattctgcttttaacagtgaaaaaagttctcgtgtcagaaggcatacaccaagccggccatgtgacggcaaagcgcttcacaggcagcggagatatgtcatcgtgaaaaaggtcgtgctgatcggaaacggcggacacggaaaagtcgtgaaggaaatcgtgcaggcccgttccgatatggagcttgcgggcatattggacgacggattcagcggttttaccgctcggaacggtttatatacgggccggacggaagacgtgcacatgcttcggaaactcgtccccgaggccgtgttcacgatatgcatcggccgcaacggcgtcagaaagcagttcgctgaaacgcttgggattgaagctgccgattatgcttcactcattcaccccggggcgatcgtcagtgaaacggcttccgtcggacacggaacggttgtgatggcgggcgccgtcattcaggcgggcgctgacatcggcgcccattgcatcatcaatacgggggcggttgccgatcacgacaatgcaatcggagattacgtccatctttcaccgcgcgcggcgcttgccggcggagtgaaagtcggggaaggaacgcacatcggaatcggcgcgtccgtcataccgcagatggacatcggcccttggtccgttatcggcgcgggggctgcggtcatcagcagaattcccggccatgtgacggcggtcggcgttccggcccgcgtcatctcccctatccataatgaaaaaggatgatttcatgcaaacaaacaaacggatttatttgtctccgcctcatatgagcggaaaagaacaggaatacatcgcagaagccttccgaaccaattggattgccccgctcggtccgctcgtcaattcgtttgaagcgcggctcgcggaatatgcgggagtgaaaagcgcggcggccttaagctcgggaacggccgccatccatcttgccctgcggcttgcgggtgtgaaaaaaggagacgttgtattttgtccttcctttacgtttgtcgccacggcgaatccgattgtgtatgagcaggctgagcccgtttttattgattcggaatgggagacgtggaatatgtcgcccgctgcgcttgagcgggcgctccgggatgcaaagcggcgcggcagactcccgaaagcggtgatcgccgtcaatctttacggccaaagcgcgaaaatggatgaattaatgagcctttgtgacgcatacggcgtctgtctgattgaagacgctgccgagtccttaggatcaacatataaaggcaggcagagcggcacgttcggccgtttcggcatttattcctttaacggcaacaaaatcattacaacatcgggaggcggcatgctcgtgtctgacgatgaagccgcgattgaaaaagcgaggtttcttgcgtcacaggcgagagatgccgccgttcattaccagcacagcgagctcggttacaactacaggctcagcaacattctcgcgggcgtggggatatcgcagctggaagtgcttgaagatcgcgtccgggcgaggagagaaatctttcaccggtatcgggaagcgctcgaaacatatccgggcatccgcatgatgccggagcttgaaggaacggtttcaaaccgctggctgacggctctgacgcttgataacggcgtgacgccggaagaagccgtcgcctgtcttgcggaacagaatattgaggcccggccgctgtggaaaccgctgcacacgcagccgcttttctcatcttccgtcttttatcctcacagcgaccatgagcgtgtctctgagaaccttttcagccgagggatttgtctgccgtccgggtctgacctgtcttctgaggagcagcagcgtgtcattgacgcacttgcgcaactgtttgaaacgaaaggggagaaaacatggacagccgccatgttatgagccgattaaaagagacgctgacgggtctgctcagcgttataccgccgcaatccgacatcatatatgccgactatcccctctacggaaatgtaggggatttattgattatgaaagggacggaggcgttttttaaagcgcacggcatccgcgtgaaacagcgctggaatcccgacaattttccattcgggcgccgggcggacaaaaagacgatcatcgtctgtcagggtggcggaaatttcggggatctctatccgtactatcagacgttcagggaaaaaatcgtcaaatcctttccggaaaacaggatcgtcatcctgccgcaatcgatttattatcaggatgagacacggctgcaaaagacatcggcgctttttgcggagcacaaggatctccacctgtttacgagagatcatgtgtcatacgagactgcgaaacgctttttttcggcgaatcatatcgggcttatgcctgatatggcccatcagctgtatccgatcgcggcgtcagcggttccgtcacgcggcaggctttattttatccgcacggatggggaaatcaacccgaagctgcaaaacaattcttccgttaaaagctgtgactggcaggatgttctgtcagcaagcgaccgcaggggaatcgcttttttccaaacgctgaatgttttgaataaaaaagcgggaaacccgctgccgattgcgcggttttggaaccgctattccgatttcttaacgaaaaaagcggtcctgtttttcagcaggtacgaatcggtggaaacgtcaaggctccacggccacatcctgtcctcgcttctcgggaaaccgaataccgtcattgataattcatacgggaaaaacgcgaactattattacacctggacgcacgaagcgccggacgtccggctgatcggtgaaaccgccggcacgaaggaaaaccttccgctttgaatgagcggaaggtttattttgtttctccgcgttttactttgttgtacgcctcatccaaatgctgaattcttttgagcacaaccgagtttttcgtcagctgatcctgtacaagggttgagacgacggagcggtaatagctgttcatcgcatgaattcggtcttcattcggattcatttcaatgtgctgtgtaaagttttcaataaaatagggaacagaaaaaagttctgacatctataaagcaactccttttaataagtatatacggtatgaaaccaatcatgtacaatgaaaaaaggggagtgagcatgatggatatcaaacttcagcaaacacaaatgttaaagcctcaattaacgcaagagcttaaacaggccatcacattactcggatacaattccgcggaactggccggatatattgatgagctctcactggaaaaccctctgattgaacgaaaggaaacagacacgccgccactatcttaccataaaacaaataaaaacaggatgaaagaacgggacggaagccagcagatcagacttacccgcaaaacgctgcaggattcgctcaaacagcaagccttagacatgaagctgtccgatgatgagaaaaaaattttcaattatctgatacattcattggattcaaacggttatttaaaagaggacataccagccgccgccgaccatgtatccgcttcacaagaggagacggaagcggttctgaaaaagcttcaatcccttgagcccgcgggaatcggcgcccggtctttgcaggaatgcatccttcttcagctccgccgtctgcccgagcggaacgaacaggcggaatggattgccgaagcctattttgagctatttgcaagaaagaattggaaagcgcttacacttaaaacgggcattccgcttaaagacattcaggacatcgctgacatgatcagcgcgcttgatccgaggccggggctccgttatgcgcatgaggagccgggtttttacgtagaaccggatattttcatcacggtgaaaaacggcatcattcaagcgcggctcaacagccgttcgtttcctgacatccagcttcatgcccattatcagccgctcttgtcagccgccgggtgccgtgacacgaaaaattatctgtcggcaaaatatcaggaatggcgctggctgaaccgggctttgtcgcaaagaaaacaaacgatcacgagaattatcggcgtcctgactgaacggcaggaatccttttttctcacaggaaaaagcggaatgcagccgctgaccttaagagaggtggcggaaacgctggagctccacgaatcaacgatcagccgggccatcaaagggaagtacgttcagacgccgtacggactgtatgaaatgaaaacatttttctcggcgaaagctgaatcatcgggggacggcggcgcctccaattatgccgtaaaagcgcatctggaagcattggtccgtaaagaagataaaaagaaacctttttcagaccaaaagcttgccgatctgctgcatgaacaatatgacatccgaatctcaaggcgcaccgtcgccaaataccgtgaccaattaaatattccgccgtcatcggcgagaaaacggtacagctgaaacctccccgagccaaaccccggggaggttctccgtgttacgggatcatccatgaaaacagatgatgctgtaaaaatgtaatgagacagacgagcagaagcaaaaacagactgtgcttaatcgtaaagcggaaaaggtcggcttccttgcccgccagaccgacagcggcacaggcaaccgcaatggattgcggagaaatcatttttccggtgacaccgcctgatgaattggcggcaacggagagaaccgggtccatcccgacagatagcgccgtcaccttttgcaatccgccgaacaataggttggccgatgtatcagagccggtaataaatacgccgagccagccgagcaccggcgaaaaaaaggtaaacatcgcgcccgtcatggcaagcgcaagaccgagtgtcgtgctcatgccggaagcattcgtcacatatgcaaagccgacaacagaaacaatggtcacgaccggaagcgttaactctttcaccgtttctataaacgcttcgccccacgtcttccacgacatgccgagggcgaacttggagatgacggcggcaatcagaatcgccgttcccgctgaaccgaaaagctcaagtttgtacacggcttcaatcggcgtgccgtccgcctgaagaatctgctgatttacaaatgggacgggaggcgtgaaggtcaatgctttcccggctgcattcagccaggaaagccacattgacgttccttcataatgaccggttaaagcagccttcacgccgggaatcccccaaacggatatcatggccgtcagaagaaggaaaggagaccacgctttaaacaccgcggcgcccccgtacttgatcggcgcccggtcagcggccgctgctgattcccgttctgccgcgaaacgaaaggccgttttcggtttccaaaatttcaaaaatacagcgagcgcggccatggaaacaagcgccgacagcacatccggaagctcaggccctaaaaaattcgagcttgcgtactgcacggccgcaaaggagacgccggaaacaagaatggccggccatacttcaaaagcctttttaaacccgctcatcaaaatgattaagtaaagcggaataaagacggataaaaaaggaagctgccggccgaccatttgggaaatttccattgccggtatcccggtcggaccttcgacggcggtaatcggaatgccgatcgcaccgaaggcaacgggcgccgtattggcaatcaggcaaattcccgccgcatacagcggctgaaaaccaagtccgacgagcaaagcggccgagatcgcgacgggagcgccgaaaccggcggcgccttctaaaaatgccccgaatgaaaaggcgatgagcagcgcctgcaaacgccggtcatctgtaattgagagcaccgaactccggataatctcaaactgtcccgttttcacggtgattttatacagaaagaccgatgtgacgataatccagccgatcggaagcagcccgtacaccgctccctgagaagcggacatcaccgctttttccgccggcatgccgtaaacaaatacagcgattaaaagtgaaacggctaacgttaaaagccccgctatgtaccccttcatccgtttcaccgcaagcgcccaaaaaaagaagataatcggcacgagcgcgcaagctgccgataaaagcaaatttccccctaaaggagcgtacccctgtgtccattgcatccctaaaaaacccctccttatgtcatgtaaacgattactttttatgataaggtcatctgatgaccgggttaattagcattatattttgaaagttttgaaagtacaatacttttcttgaacaaattgtctgaacctgtcggctacacaaaaaaagaagtataatagacgataaacatcaagattcacaagtgacggggtgatcgcgttgaaatataaacaaattaaaacgaaaaaaatctacgaggaagtcgctgacgcattgctggagaagataaaagcgggcgagcttaagccgggggaaaagcttgattctgttcaggcgctttccgagagttttcaggtcagccgctcggcggtcagagaagcgctgtcggctttgaaagcgatggggctcgtcgacatgaagcagggagaaggcacatacataagagaatttgagccgtctcatgtttcccagccgctttcttccgccctcttgatgaaaaaagaggacgtcaaacagctgctcgaagtcagaaagctgcttgaactcggcgtcgccgccatggccgctgaaaaacgcaccgaagacgatttacaaaaaatccgccaagctctcatggagatgaaagacattgacggagacgaagaattgggcgaaaaagcagatttctcctttcacatggcgctggcggaagcatcacaaaacgggctgcttaagcatctcatgaatcatgtctccgcgctccttttggaaacaatgagagaaacgagaaaaatttggctgttttctaaacgaacgagcgtgcagcgattgtatgaagagcatgaacgcatttacagcgccgtcgccgccggagacacggatgaagcggaagcagcgatgacggcgcacctgacgaatgtggaagaagtgctgggggcttattttgaagaaaatgtatagaagctgacttgtgaaaggggataacatcacatgcaggccgaatcttttttttctgaccatgtaaagaaagctctgacaaatgatcctcccggggaatggatgccggcagttccgaaagcgtgcatccctctgcattccggctatcccgatcccgcgctcgttcctgataaggagctgaaagaagccgcctcccgccttctggatgaggagcgtgatctgccgctgcattatataggaagcccgaggacggccgttttaaaaaagcagattcaagaacggttagccatccgcggcattcactgccgggacgatgagctgatcgtgacatcaggcgcctgtcaggcgatagatctggctgcgcgggttttcctcgatgaacaaaccgccgctgccgttgaagctccggtctatatggaagcgctcgagatttttaaaaattatacaccgcatatcatgagcattccgacagatcaagagggtctgcaaacagaaacattagcgtttatgcttgaggaaagaaaacgaaaagggcttgtgcttccccgtcttctctacacgatacccgcttttcagaatccggcgggaaccgtaatgtcatcgaagcggagaacccgcctgcttcagcttgccgaaacgtatgattttctcatcttggaggatgatgcatacggcgagctcggattcaccgatattccgccgcccttgaaagccatggatcaaaacggccgggtgctgtacgccggttcattatcaaaagtcatcgccccgggtatgaggatcggctggattgcaggggacgccgcattcatcacggcattgtcatggttaaaaaaagacttaggccatccgttttcccaagcggtgaccgccgtctatctggaacaaacgaatattgaagaacggctcgccgccttgcgggaagcatatcgaagcaaacgtgatgttttgctcgccgcatcagcgcgatatcttccggaatccgcatcctggcacgtgcctgaaggcggttactttgtatgggtgaaagcgccgggggctgatacgtccgcactgctggcgagggctctgtctcacggcgtttcctatgtacccggaaaatatttttttccgcatcaggaagacggtgccgaatatctccgcctgtcgttcagttttcccggtaaagccgcgataaaagagggtgtgcaaaaactgggacacctgctgaaaaacgggatctagagaagcatgggaagctttcaggcttctcttttttttacccttcagcgcatcgggcgaaaggatttttcagaaaaaccttccaatccatattcagaatagtgtaggatatttatagagctttccaaaaacaggtcatcagatgaccggatcacatactgaggatgaaagaggggttcatcatgaaagtctcattatttgtcacgtgccttgtggatatgtttcagaccaatgtcggaaaggcgacggttgaggtgctggaacggctcgggtgtgaggtggattttcccgaggggcagatttgctgcgggcagcccgcatacaacagcgggtatgtgacggatgcgaaaaaagcaatgaagcggatgattgccgcgtttgaagaagcggagtacgtcgtcagcccgtcaggttcctgtacgacgatgttccgtgaatatccgcatctgtttcaggacgatccgaagtgggccgcaaaagcgcagcagcttgcggacaaaacatatgagttaacggattttatcgtcaacgttctcggggtggaggatgtcggggcggtgctgcataaaaaagcgacagtccatacatcgtgccacatgacgaggctgctcggcgtgtcggaggagccgatgaagcttttgcgccatgtcaaggggctcgagctgaccgcgcttcccggaaaacaccaatgctgcggattcggaggaacattttctgtgaaaatggcgcaaatctctgaacaaatggtggatgaaaaggtcgcctgcgtggaagacacggaggccgaggtgctgatcggggcggattgcggatgtctgatgaatatcggcgggcgtcttgaccgtaaggataaaaacgtcagagtcatgcacatcgcagaagtgctgaacagcagataagacgagaaacaacaagggggtaaaatcatggcgatgaaaatcggtaccgccgcttttaaagagcgggtatcagaaggaatagataatgagtttatgagaggagccgtctccggagcgcaggaacggctcaggataaggaggcttcaggcggccgaggaattgggaaactgggaggattggcgttcacatgcggaagaaatcagacagcatgtgctggacaatcttgatttctatttggaacagctcgccgaaaacgtcgccaacagaggcgggcatgtctttttcgccgaaacggcggaagaagcgtcctcctatatccgcgatgtcatccggcagaaaaacgccaaaaaaatcgtaaaatccaaatccatggtgacagaagaaatcaatatgaacgaagtgcttgaggaagagggctgtgaagtcacagaaacggatctcggcgaatacattctccagattgacgatcacgatccgccgtcacatatcgttgctcccgctcttcacaaaaacaaagagcagatccgtgacgtgtttaaagagagactcgaatacaaacagacggaaaaaccggaagagctcgtcatgcacgcgcgcagcgttctccggaaaaaatttctcgaagcggatgtcggcatcacgggctgcaactttgcaatcgcggataccggatcggtcagtctcgtgacaaacgaaggaaacggccgccttgtgtccgcgctgccgaagacgcagatcaccgtgatgggaatggagcggatcgttccttcattttctgagtttgaagtgcttgtcagcatgctgacgagaagcgcggtcggccagcggcttacaagttacattacggcgctgacgggcccccggcagcaaggagaagctgacgggcctgaggaatttcatctcgtggttgtggataacgggcgttcccgcatactcggcacggaattccaatcggtgctgcaatgtatccgctgcgccgcctgcatcaacgtctgtcccgtgtaccggcatgtcggcggacactcgtacgggtccatctattcgggtccgatcggcgccgtcttatcgcctcttctcggcggatatgacgaatacaaggagctcccgtacgcatcttccttatgcgcggcctgtacggaagcgtgtccggttaaaattccgctgcacgagctgctgctcaagcatcggcagaacattgtggaaaaagagggcaaagcgccgatcagcgaaaaactggcgatgaaagccttcgggctcggctcgtcatccccgtccctttataaactgggatcgaaatgggcgcctgccgccatgacgccgtttacggaggatgacaaaatatcaaaagggccggggccgttaaaagaatggacggcaatacgggacttcccggcgccgcataaatcgagattcagagattggtttaaagaccgggaaaaacaaaagggggaagaatgatgatgaaagggacggttacacatcaggaatcctttctaaaccggatcgccggaagtctgggcagagagcgcaggaaatcaggcgtgtccctgcctgaatggaagtatcagcctcaatatcaaacgcatgcggactgtacggaagacgatcttgtcacgatgctgaaagaccactgcgtcaacattcataccgaactgatcgaaacggatgcagccgggctttacgacgctttgcgcacgcaggtgaaccgctttgaaggggggcctgtcatcattccgaacgacagccggtttgaaatgtacggcttgcagacccttatgacagaagagtggccggacgaagggattcccgtttgggaatgggacgcggaacaaggagcgaaaaatattgaaaaagcggaacaagcgaatgtgggcatcacattcagcgagatcacgcttgcggaatcagccaccgtcgttttgtatgcgtcagagcatgccggccgttccgtcagcctgcttccgaccacctatatcgcaatcatcccgaaatcttccattgtgccgagaatgacacaggccagcgatatactgaaacagcagatcagagacggcgtcaccgttccttcctgcatcaactatattaccggaccgagcaactcggccgatatcgaaatggatttggttgtcggcgtccacggacccgttaaagccgcttatatcctcgtgaatgaccgataaaaaaacaaaccccggtttgcggccggggtttgtttttatataaacgcgttaatgatcatgataaaacagatcgcactgacagaaataatcgtttccatcgccgtccatgtcaggaacgtttcttttaccgtcattccgaaatactctttaatgagccagaaaccggagtcattgacatgtgacagaatcaaagagcccgctcccgttgccaaaacgagaagctcgctgctgacgcccggcatgacagatgcaatcggagcaacaatgccggccgccgtcatcatggcgacagtcgctgaacctgtggcgacacggatgaccgccgcgatcgtccagcttaaaagaacgggagagaagcttgagtgcttcgccatgtcagcgatatacgtgccgacgcctgaatcaatcaggacgttgttaaaagcgccgccggctccgatcacaagcagaatggaagcgatcggtcccagacagtcattgctgaattttaaaatgctttccctgtcaaagccctgataaaaaccaaggctgaaaaaggagtaaaccgtggcgatcaaaagcgccgtgacagggtcgccgataaatttaaaagtttcatagagcgtgcttttttccggaagcgcaatttcggcaagcgttgccataagcatcaggatcaccggtaccaatatcgtaaacaatgtatttgcgaatcccggaagcttgcgtttttcattccgttcaataaattgttttttcaacagttcgggaacgggtttatgaatgcgcttaccaatccattttccgtaaagcggccccgcgatgatggcagtcggaataccgacgattaaagaatacaaaatcgtttttccgacattggcgtgataaatgccgacagccgccatcgccgccgggtggggcggaaccaatccgtgcacgacggaaagtcccgcaaggagcggaatcccgatcgtcactaatgaaaccccggtttcaatcgcaatcgtaaacaaaagcggcacgagcaggacgaagccgacctggaaaaagaccgggatgccgacaataaaagcgacggccatcatcgcccaatgcactttctttttgccgaagcggccgatcagggtgtgggcgatccgctccgcaccgcctgattcagccatcatttttccgagcatcgtaccgagggccagcacgatcgcaagcagagacagcgtattgccgagcccggttttcattgaagtgataatgtccggcagattcatgcccgttgcgaaaccgacaaggatggatgtaatcaaaagactgataaacggatttaatttagcgaccgtaatcaataagagtaaaacgataatagcggcaatgacaataaacagtaacatgaccttttcaccctttctttcaaagaagaattaacggctttgtttgagctgaaattcactgatgacgtcaaattcatctttgagcttgtcatacagccgctcgtataagtaaaacagctcaatatatgtttcgctgtttttgacgttcggttcatggcggtgcgaaattctgatccagtcctgaacatcctcgatccgttccatttcgccaaggctgtgcaaagcgagaacggccgctccgagcgcagaggcttcgtaactttccggaacgaggacttcgcgtcccatcgtatcggacaaaatctgcctccacagcggcgatctcgcaaatcctcccgaagcccgcacgtcttttgcggggcccgccaaatctctcagtgcgacaccgattgaaaagacgctcatgatgacgccttccagcaccgctctgataaaatgctcccgtttatggcggaggctgatgccgaaaaacgttccgcgggcattcgggttccaaaacggcgcgcgctcccctgataaaaacggcagaaacagcaatccctcagagcctgcgggcactttatcagcaatatcaatcattaaatcgtacggatcaatgccgagccgcttcgccgtttcaacttccggagaagcgaattcgtctcgaagccagcgcagcataatgcctccgttattcgtcgggcctccgatgacccaatgcttgtcagtcagcgcgtaacagaatgtccgcgctttttcatccgtaatcggcgcatccgtcaccgaacgcacggctccgcttgttccgatcgtaacggccacttcgcctttgccgatcgcgccgactcccaggttggcgagcacgccgtcatttgcgccgataataaacggtgtatccgcatggatgcccatccgtgcagcgatttccggcgcaaggccgcgcagctgatgagtggtcggcacaatgtccgacagctgatcttcccggattccggcaatcctgagcgcttcttcatcccaggaaagcgtatctaatcggaacagtcccgttgccgaagcgatcgaataatcgacgacataagttccgaaaaactcgtgcagaatatattctttaatactgatgaatttggcggttttcgcgaatgtctccttgtcctgttctttcatccacacaattttggaaagcggagacatcggatgaatcggcgtacccgttcttttataaatatcaaaaccgttcatctcttttaaaatccgttttgattgctcggcgctgcggttgtccgcccaaatgatgcttttggtcagcaggccgccgttttgatcgacagctatcaatgagtgcatggcggtgctgatgccgattgcaagcagattgtcaggactcagtccggcctttgtgacggcgcccctgatgcttccgatcaccgcttccaaaatgtgctcaggatcctgctcggcccatgccggctttggctgtattaaatcatagtgaaccgaatgcttggctaacactttgcctcttggtccgaacagaacagctttcgtactggtcgtgccgatatccagaccgataacagcttgggtttccttcataatatatcccgcctaatctgattgaataataagatagatttataatgtatgcccttacaaagtcaattataggaataatttttttataaatcaacgatgaagaagaaaaattttttcataaaattgcctcaattcccgctgtatcggctttctctcttttgaaaaaaatatttagaaaacgattacaaacgtttgtgcgcgatcatttttctgatttgctgcaagttggcgagcgttttctcctgccgcagccgggccgtggcgaaatacagtgtatcaatgaccgacagctgggcaagccttgcggacatcgcctccgttctgaaagccgtctcccttgttgatgtatacagcacaacgtcggaaatctgggtgagcggcgacttttggtagcttgtaatgccgatcgtgccggcgccgagcgatttggccgttttgaccgcgtcgagcacgtccttgttgctccccgaatgagaaatgccgatgactgcgctttcaggaccgagaagacccgctgacatcgcctgaaagtgagaatccgtatgcgcgatgcaatttatacccgtacgcataaatttatgatacgcgtcagtggcgatcagcccggaaccgccgtttccgtaaaattcgattctgtctgcgcggtggatcatttctaccgctttttcaacgtcggccggatctaataattgaaaggtatcggtcagaccggaaatgtttgtgcggaaaactttccggatgatgacttcgatatcgtcgtcggggctcatttcttcatgaatgtgctgcaccggctcctgaacgatctcctgagccagcgcgatttttaaatcctgatagccggaaaaaccgagccgcttgcacagcctgaaaatcgtcgcttcagagcttttcgttttttcggccagctgaatgatggaaaggtgaaccacgtctttcggttccttcacgatatggtctgcaatcgctctcaattttggcgacaaacctttgctggccgcctgaatcttcccgatgctgcttgaattcacaggggtcatactataacctccctactcgaatgtaaacgcatacttttatgataaagcaagtttcaatataaggaaaacagaattttaaaattgttttttcaattttgtgtgtaaaaaaagagaaaaagccgccgatgatagaaagtgaggaggcatctgaatgaaaaaagcatggattctcgtcatatcattcggcattgcgcttgcgctgtttttatacgcaaacacaaaggtgaaagcggaaagcatggcgccggaaagcaaagccttgtgtccggatttcagctgaaatttccgaatcaccgggaaggacaatagacggaaaaaattagtattgactttgaaaatagaagactgtatattatgttactatattcagaaaataaaaactcaagagattcatttaacataaaacactgtgaacgggagcagtaagagaatccagtcagaaaaagagagccgcgggttggtgaaacgcggactgattgttctttgaactcgcccggaagtggcagggcggaacggaattgtcggaatattccctatgtcctaacggctgaccttcgttaaaaggtttttaagctggattccggatattcgggatcaacaagagtggtaccgcggctgcctgaggcacgccgtctcttttcctaaagaggcggcgtgcttttttatgtgatgaacactttttgcgagagggcgtgtgatagatggaaaaggacaagcaaacgttaaaacggacgatgtcgtccagacacattatgatgatggcgcttggaggcgcaatcggggccgggctctttaaaggcagcagcacggcgattgatgaagcggggccgtccgtgctgttggcctacctcctcggcggaatcattctgctgtttattatgcaggggctggccgaaatggccgtcagaaacaaacatgcaaggacgttccgtgatttggttcagcagtctctcggttcgtacgctgcatactttttagactggatctattggaaaatgtgggtgctcaatattgccgcggaggcggtcgtagccgccattttcattcaatattggctgccggaatgtccgatatggatactggctttgatcatttccatcgtggtgacggtcgtaaacatgctttctgtgaaactgtttgccgagacggagtactggctcgcgctcattaaaattacggtgattgtcatctttattttatgcggaattctgctattatttttctcattcggcaatcacacggcgccggggctgtctcatttaacggatcacggagggtttttcccgcatggagcggggggcgtcattacggcgatgctcgtcgtgatctactcatacggcggaacggaaatcatcggcgtcacgctggcggagacaaaaaaccccgaaaaggtgattccgaaagctgtccgaagcacgttaacgcggattgtcgctttttacttgctgccgtttttcatcatcgtcagcctgattccttggaatcaagtcaacagcgttcccgaaagcccgtttgtcatagtatttaagatgatcggaattccgggtgccgaccatattatgaatgccgtcattcttcttgcgattatctcgtctatgaactcgggactgtacggatcatcccgcgtcttatttacgcaggcttctgacggccgggtgccgaaaatcttttcaaaactatcgaagaaaaaggttcctgtctatgcgattctgacttgtacgtcatttttatatgtaggcgtcctgatttctttattcgcaggaagccggacgtttaattatttgatgggttccctcggctataccgtgctgttcatctggctgattatcggattcgcccatttaaaatcaagaaaacattcaacagaacagccggcttattacgtcaaatggttcccgtacacgacatggttcgcggtgcttgcgcttttggccatcctgatcggcgtaattgcgacgacgtccatcgtcatcacatgcatcactgcggccatctacctgctcattacggctgcgtatctcgtgaaagggagacgtcaataaataaaaaaactcttgccccgcggcaagagtttttttaatgaacggcctttttttctgcggccagagcaggtgttttcagtttcttcggtgttatattcacaaaacaaatgcttgtgacgatcagaagcagtccggctaaaaggctgacggtcagcggctcatgcagaaatatcgagctgacgacaatggatatgagcgggatcaggaaggtgtaagaggcaaccttgcttgcttcccctgaaccgacaagcgtaaaaaaggcgagccagccgagtgcgatgacaaataccgaaatgaacagaaggctgagaatgaacggagttttccattgaatcgctgaaaagctttctgaaaaatggccggagctgacaagcagcacgccgccgatcagaagctgaagagcgaccatccagatagagtccgcgcgtccgcccgttcttttcacatataccgtgccgagcgcccagctgaccgcggagcccagagccaaaagaatgccggcgatggaaatatggcctccgaaaccggctgcgctgatgacggcgacaccggcaaagcccagaataagaccggctatttttaaaggatacatcgattccccgagccacagccaagaaaaaacgcccattaacaccggctggaaaaacacgatggctgaaaataagccggcatgcaggtaattcaagccgaccgtttgcaggccgtaaaataaagtaatatttaaaatggcagaaataagatagatcggccacgtttctttaaaacgcagctttttaaaacggggcagcgccaccattaataatagaagtccgccgatcagcgtgcggattccggcaaacagaagaggcggcgaataggcgagcgcggcttttgtcagcggccagttaattccccataccgtgactagaaacgccagcataagagccgtctgtattttcgaaagctgtttcacgtcgttcactccttgtagaacaattccatcatatgatacggtaatcagtaagataaataaaatgaatcttttttataaggagcataagtaaaacgttatgacgattacacaactgcgggtttttgttcaaatcgctgaaacgggaagctttacaaaagcggggcaggcgctgaatatgacacagcccgccgtaagccatgccatctcggcgcttgagtcagagctcggcatcaagctgatcatccgcgagcgccgcaacggcgtaaggctcacggacacgggcggaaaaattctcgttcatatcagagaggtgctcaaaggcatagaaaaagccgagcagctggcggccgcggaaagagggcttgaacagggaacgattcacatcggcacatttccggccgcttccgcttatttcattccaaaactgatcagcgtgtttaaaaaacggtatccgaaacttgagttggtgctttatgaaggaacggttaacgaagtaaaggaatggctccgctcccgggtaatagatgtggggatcactctttttcctacggaagacatggaatatctgccgctgaaaaaagataaaatggccgtcgtgcttagaaatgatcatccgctttgcagctgtgagtcaattactctgaaagatcttgaccgccagccgatgatcatctgtgacggaggatacgaatcaccgtttattgatatgtttaaggaggcagggtctgtgctgactgccgcattcactgtttacaacgtcaatacgtccatcagcatgatcaaagaggggctgggaattgcgatattatcacaaatgtctatgtccggaatatcactgccggaaaatgtcgtgacaagggaactcaatcaggcggtgtaccgtgatgttctgcttgccgttccttctgtaaaagaggcttcattggcggcaaaactttttattcaaatcgcgcaggagctcacaaagaatgaataaaaaggccctaatgatcttagggccctgaatcttatcggttaattttaaaagagtttgtcgtattgacaagttttgaaccgctgaacgtagctttgacacgataataacctgtcttgcatccttttaaagagaatgacttagtcacccttactgagaaagaaaaggttgtttttttgcaagtcgtccatttctttccggactttcgctgtaagtataggtttcctttaaaggttcgatctgacggatacgctgtactgagagtaaaatcgacacttttcgcttttttcgtgtagtaggaggcatcggtaaatccgcttacatttaaatgctgctgagtgccggaataaaagtctgcggcatatgccttatcggtgtttccggtaaagaagattgctgccagtaaagctgttgtgagtgccattaagatttttttacgcatatagactatgacttccttcctattcaatatatgacatatgttaacattattggttctgttctttcaatgatatcttttcatttttatatcattctaggctcttcatatctgaatgtaatagattcattcatacagagttcactagtgacgaccgctgactgattgttcgaagatcatcgaatcaaattgtttaactcacgggaaaagctgtggtaaggtgtgtggtagagaccttgtttaagatctgcttacactaaaccataaaggagaaaacgatggctgaacatacattgaaagatactgcgttttccgtattgaatttatcgccggtcgtacaggggggaacggttgctgaatcgttccgcaacagcatggatttagcgcaccgcgccgaggagtggggctataaccgctattggctggcggagcatcataatatagaaggtgtcgccagctcggcaacggcggtgctgatcggccacatcgccggcggcacgaaaaaaatccgcgtcggttctgggggcattatgctgccgaatcattcgtcacttataatcgcggagcaattcggaacccttgaaacgttatatccggggcggattgacctcggactcgggcgtgcgccgggtaccgaccaattaacggcgagggccttaagaagaaacataaacagcggggaggatttcccggagcagcttgaagaattgagaaattacttcaaaccctcaggcaatgtgcgcaatcaagtccgcgccattccgggcgaagggctggacgtgccgatctggcttttgggatcgagcggcttcagcgcgcgtcttgcgggagagctcgggcttccgttcgcctttgcggctcacttctcaccgaaaaacaccgtgcccgcccttgagctgtaccgaagctccttccgtccgtcagacgtactggatcaaccgtacgcgatggtcggcgtcaccgtcattgccgccgatacggatgaaaaggcggagcatctggcgacatcgcattatcaaagatttttagacctcgtccgcggcacgccgaaccagctgaagcctcctgttgaagacatggatcaaatctggtcgccgtatgaaaaagcgatggtcaatgaacagctcagttcaacgatcgtcggcggaccggagcgtgtgaaggaaaagctggaaagcttcatccggacaacacaggcggatgaaatcatggtgaattcagaaagctttgagcatgccgacagaatgagatcatttgagatcatcgccgaattaaaaaacagctgagcaaaaaaagcaatgtgccgcgcacattgctttttttattcgccgatccgcctgacggaatttcggatgacgagttccggttcatacacgacgtcatccttcttcggttttttatgctctaagcagccgatgacgtattttgccgccgctttccccataatggatttcggatgcttgacagaggtgagcttcacctcggaaatctgggcgaaatgtgaatcatcatagcccatgattgacacgtcatcaggcacctttaagccgaattctctgagaagattaatcgtcttcagcgcaatttcatcattataacaaagaatggccgtcgggtatgatccgctgttttgctcaagggtatgcttaattttttgaagaagcacggtttctttttcttcagtcgtgtaagtcacgatcatgtccggagacggaaaaatcccgcgctcccggtgcgcctgaagatagccgttcatccgtttgacgccctgcgtgtcatccgctttaaagattcccataatgtgcgtgtggccgagggacatgacgtattcgcaagccatcatgccgcctttgacatcattgacggaaaagctcggtgcggccagctccgcataagaggcgttaatcatggcaaacggaatgccgtttttctccaggttgagatagtagccgatgttgggcgtctgcagcgcgcttttcgtaggctcgacaatcagcccgtctatatttttggacagcaggttttcaaggccccgccgctcactttctgtattgttgttggtgctcgtcagcagcatggaatagccctgttcgcttaaataagattcaattcccctgatgatgctcgggaaaatatagtctgatatgtacgttgtaatgacaccgatcgttttgtttgaatgcatggctgatttcgccgtgcgtgaagcgacaaaggtgcctccgccctgaacgctgtacagcaacccctgcgagaccaaatctccgatcgcctttctgatggtatggcggctgaccccgaactgctgcatcagctcattttccgtaggcagcttttcgtccggctgtatttttccctgattcagccatgaacaaatttcttcttttacttgagcatatttcggtagcatatcaattcctccaaaatgtatacggacaaattccagtataacatagtaagccctttcatcaagctgtaaaaataattgacagattgtgaaaaactgcttattctttatttgtacgtactaattttccttatttttagataaaattctttataagtacgtacaaatgtggcggttctgaagaaaacaaagcaactcaagcgccgcactttgttttgtaagcgtttttattctattattcgcgggagggtaaaattcatgaagaatcacccggcaccaattggctcaaatgtacctgtcactcggcagcattcgaagtggtttgtcattctcatctcatgcgcggccggactgggagggcttttgtacggttatgatacggcggtgatttccggcgccatcggtttcctgaaagatttgtaccgcttaagtccttttatggaagggctcgtgatttcaagtattatgatcggcggtgttttcggcgtcggaatttccggatttttaagtgaccggttcggacggagaaagatattgatggcagcggcgctgttgtttgcggtgtcagcggttgtctctgcgctttctcaaagtgtgtcttccttagtgatcgccagagtcatcggcggtctgggaatcggcatgggctcctcgctttctgtcacgtatattaccgaagccgctccgccggccatacgcggcagtctttcctcactgtatcagctgtttacgatattagggatctccggcacttattttattaaccttgccgtccagcagtccggctcgtatgaatggggggtgcacaccggctggcggtggatgctcgcttacggcatgattccgtccgtcatcttttttatcgtgctgcttatcgtgccggaaagtccgcgctggcttgcgaaagcggggcgccggaatgaagccctcaccgtgctgacgcgcattaatggcgagcagaccgcgaaagaagaaatcaaacaaatcgaaacgtctttacaattagaaaaaatgggttcattgtctcagctgtttaaaccggggctgagaaaagcgcttgtgatcgggattctgctggctttattcaatcaggtcatcggcatgaacgcaattacgtattacgggccggaaattttcaaaatgatgggcttcggacaaaatgcggggtttatcacgacatgcatcgtcggtgtcgttgaagtgattttcaccattatcgcggttcttttagtcgataaggtaggccggaaaaagctgatgggggtcggatctgcctttatggcgctgttcatgatcttaatcggggcatccttttattttcagctggcgagcggtccggctttagtcgtcatcatattgggattcgtcgccgctttctgcgtatcagtcgggccgattacgtggatcatgatttcggaaatctttccgaaccacctccgcgcacgcgccgccggtattgcgacgatattcttatggggggccaactgggcgatcggccagttcgtgccgatgatgatcagcgggttggggctcgcgtacaccttctggatattcgccgtcattaatattctctgtttcttgtttgtcgtgacgatctgccccgagacgaaaaataaatcattagaagaaatagaaaaactctggataaaatgaaagcgttttacggcaaaagtccgctgcggcgggcttttgtctgtcaccttcattccgtttctgtatataatgactgtatcaaggagatactggtaaatcctgcgaagaatgtcgaggaattgacctttaacagttgaattaacaatgtcatcctgttaaaataattaaagaaagcagacataattttttttggctatgatgggacgttttttgtcatagcgggacattttctgtccagtatgaataggaaggaacgtttgagtcatgaaccagttaatacaagctcaaaaaaaattattgcctgatcttttgcttgtgatgcagaaaagatttgaaatcttgcagtatatcaggcttacagaaccgatcggccgcagaagtcttgcagccagtctcggattgaccgagcgcgttctcagaagcgaggttcagttcttaaaagaacaaaatctcatcgatattaaaacaaacggcatgacaatgacggaagagggctattcactgctttcgattctggaagatacgatgaaggatgttttaggattgacgcttttggaaaagacattaaaagagcggctcaatctgaaagacgccattatcgtttccggagacagcgaccaatctccttgggtcaaaaaagaattagggagagcggccgttgcatgtatgaaaaagagattttcaggcaaaaatatcgtcgctgtaaccggcggtacgacaattgaagccgtcgccgatatgatgacgccggattcaaaaaaccgcgagctcctgtttgtgcccgcaagaggcggtttaggcgaagatgtgaaaaaccaggcgaacaccatatgcgcgcatatggcggaaaaggcttcaggcacttaccggcttttgttcgttcccggccagctgtcacaaggcgcctactcatctattattgaagagccttccgtaaaagaggtgcttcacacgattaaatcagcgagtatgctcgttcacggaatcggcgaagctagaacaatggcggagcgaagaaacacgcctttggaagatttgaagaaaatagatgacaatcatgcggtgacagaggcattcggctactactttaatgcggacggagaagtcgttcacaaggtgcattcagtcggaatgcagctcgatgacctcgatgccattcccgacattatcgcggtagcgggcggatcatcaaaagcagaagcaatcgaagcttattttaaaaagcagcgaaacacggttctcgtcacggacgaaggagccgcaaagaagttattaagggataacagtccctcaatataaatatctctcacttatttaaaggaggaaataatcatggcagtaaaagtcggtattaacggttttggtcgtattggacgtaacgtattccgcgcagcattaaacaatcctgaagttgaggtagtagcagttaacgatttaacagacgctaacatgcttgctcatcttttacaatatgattccgtacacggaaaattagatgcagaagttaaagttgacggcagcaaccttgttgttaacggcaaaacaatcgaagtttctgctgagcgcgatcctgcgaaactcagctggggcaaacaaggcgttgaaatcgtagttgaatctactggtttcttcacaaaacgcgcagacgctgcgaaacacttagaagcaggcgcgaaaaaagttatcatctctgcacctgctaacgaagaagatatcacaatcgttatgggtgttaacgaagacaaatacgatgcggctaaccaccatgttatctctaacgcatcttgcacaacaaactgccttgcgccgtttgcaaaagtacttaacgacaaattcggcatcaaacgcggtatgatgacaactgttcactcttacacaaacgatcagcaaattcttgatcttccgcacaaagactaccgtcgtgcgcgtgcagcagctgaaaacatcattcctacatcaactggtgctgctaaagcagtttcccttgttcttcctgaactgaaaggcaaactgaacggcggagctatgcgtgtgccgactccaaacgtttctcttgttgacctagttgctgaacttaacaaagacgtaacggctgaagacgtaaacgcagctcttaaagaagcggctgaaggcgatcttaaaggaatcctcggctacagcgaagagccattagtatccggagactacaacggcaatgctaactcttctacaatcgatgctctttctacaatggttatggaaggcagcatggtaaaagtaatctcttggtacgataacgaaagcggctactctaaccgcgttgttgaccttgcagcttacatcgcaaaacaaggtctttaattcatagctcccggaaagggccggacttggttctttcggacagaaacgctataatgaaagcggacaagggaaggggacggactccctttccctttttccatgagaaccggctttcagaaagcgccggattgctgcagaacgtccgcgttttgaagtttccgcggcactttcgttttctgagccgcctgccctggctcagaagacgatctgccccgtgcccggaagctgcaatctgccccgcggcggaagcatcatgaggcggtttcacgtttcacgtttttcgtgctatgcaaaccattttgaaggaggatctcctaaggcatgaataaaaaaacagtaaaagacatcgacgtaaaaggcaaagtcgtattctgccgcgttgactttaacgttccaatgaaagacggggaagtaacagacgatactcgtatccgagctgcgcttccaacaatcaaacaccttgcagaccaaggcgcgaaagtccttcttgcgagccacttaggccgcccgaaaggcgaagtggttgaggagcttcgtttaactcctgtcgctgcacgcttaggcgaactgctcggaaaagaagtgaaaaaagcggatgaagcttacggcgatgctgtaaaagcacaaatttctgatatgaaggacggagacgttcttgtattggaaaacgtacgtttctaccctggtgaagagaaaaacgatcctgagcttgctaaagcatttgctgagcttgcggatgtatatgtcaatgacgcattcggtgctgcccaccgtgctcacgcatctacagccggaattgccgagcatctgccggcggttgcaggattcctgatggaaaaagagcttgacgttctcggcaaagccgtgacaaatcctgagcgcccgtttacggcaatcatcggcggcgcgaaagtaaaagacaaaatcggcgtaatcgaaagtctgcttgataaagtggacaacctgatcatcggcggaggtcttgcttacacattcgtaaaagcgcttggctatgaagtcggtaaatctcttcttgaagaagataaaatcgaacttgcaaaatcattcatggaccgcgcgaaagaaaaaggcgttaaattctatatgccggaagacgttctcgttgctgatgatttctctaacgatgcaaacgttcaaatcgtgccgatctctgagatcccaagtgatttagaagcgatcgacatcggaacgaaaacccgcgaaacgtacgctgaagttatcaaaaacagcaaacttgtcgtatggaacggacctatgggcgtattcgaaatcgacttgttcgctcaaggcacaaaagcagtggctgaagcattggcagaggcaaacgatacatactctgtcatcggcggaggagactctgcggcagccgttgaaaaattcggccttgctgacaaaatgagccatatctcaacaggcggcggcgcatcccttgaattcatggaaggcaaagagcttccgggtgtagctgcgctgaacgataaataaaaactgctataaggaagtggaacagatgagaaaaccaattatagccggtaactggaaaatgaacaaaacactcggcgaagctgtcagcttcgttgaagaagtgaaatcttccattccagcagcagacaaagcggaagccgttgtttgcgcaccagctcttttcttagaaaagctgacttctgctgttaaaggaactgacctgaaagtcggcgcccaaaacatgcattttgaagaaaacggtgcgttcacaggtgaaatcagcccggtcgctctgaaagaccttggcgtggattactgcgtcatcggccactctgagcgccgtgaaatgttcgctgaaactgatgaaacagttaacaaaaaagcgcatgccgctttcaaacacggcattgtgccgatcatttgcgtaggtgaaacgcttgaagagcgcgaagccggaaaaacaaatgatcttgttgccgatcaagtgaaaaaagggcttgcgggtctttctgaagagcaagttgctgcttccgttattgcgtacgagccaatctgggcaatcggaacaggcaaatcttctacagcgaaagatgcaaacgacgtctgcgcgcatatccgtaaagtcgttgctgaaagcttcagtcaggaaactgctgacaagctccgcattcaatacggcggcagcgtaaaacctgcaaatattaaagaatatatggcagagtccgatattgacggtgctttggtcggcggcgcaagccttgaaccgcagtcattcgttcaattattggaggaaggtcaatatgagtaaaaaaccagctgcactcatcattcttgatgggttcggattacgcaatgaaacagtcggaaacgcagtcgcacaagcgaaaaaaccgaatttcgaccgttattggaaccaataccctcatcagacgctgacggcatcaggcgaagcagtcggactgcctgaaggacagatggggaactctgaagtcggtcatttaaatatcggcgccggacgtattgtgtaccaaagcttaacacgcgtgaacgttgccatccgcgaaggcgaattcgaacgcaatcaaacgttccttgacgccatcaaaaacgcgaaagacaacgacaaagcgctgcacctgttcggccttctttctgacggaggcgtacacagtcacatcaatcatttattcgcgctgctgaaacttgcgaaaagtgaaggactgacgaaggtgtatattcacggtttcctcgacggccgcgatgtaggtccgcaaacggcgaaaacttacattcagcagctgaatgagcagatcgaagaaatcggtgtcggcgaaatcgccagcatttccggacgctactactccatggaccgcgacaaacgctgggaccgtgtggaaaaagcgtaccgcgcaatggcttacggcgaaggcccgtcttaccgcagcgcgatggatgtagtcgacgattcttatgcgaacggcattcatgatgaattcgtcattccgtccgtcatcacaaaagaaaacggtgaacccattgcgaaaattcatgacggcgattctgtgattttctataatttcagaccagaccgcgccatccagatttcaaacacgtttaccaacaaagatttccgcgatttcgaccgcggtgaaaatcatccgaaaaacctgtatttcgtctgcctgactcacttcagtgaatctgttgacggatatgtggcttttaaaccggtaaaccttgacaatacggtcggtgaagtattagcacagcacgggttaaaacagcttcgcattgcagaaactgaaaagtatccgcacgttacgttctttatgagcggcggccgcgaagaagaattcccgggcgaagagcgcatcctcattaactcgccgaaggtcgcgacatatgacctgaagcctgaaatgagcgcgtatgaagtgaaggatgctcttgtaaaagaaatcgcggctgacaagcacgacgcgatcatcctgaactttgcaaaccctgacatggtcggccactccggaatggtcgaaccgacgattaaagcaattgaagcagtggacgaatgcttaggcgaagtggttgacgccattatcgctaaaggcggtcatgccatcattaccgctgatcacggtaatgcggacattctgattacagaaacaggcgaaccgcacactgcccatacgacaaacccagtccctgtcattgtgacgaaagaaggcgtgacgctgcgcgaaggcggaatcctaggcgacctcgcaccaacgttattagaccttctcggtgttgaaaaaccgaaagaaatgaccggaacatctttaattcaaaaataagcgtaaatcaaaaggagagacaaactcatgccatacattgttgatgtttatgcacgcgaagtccttgactcccgcggcaacccgacagttgaagttgaagtatatacagaaacaggagctttcggccgcgcattagtgccaagcggagcttctacaggtgaatacgaagcggttgagcttcgtgacggcgacaaagaccgttaccttggaaaaggcgtgttaactgctgttaacaacgtaaacgaaatcattgctccagagcttctcggctttgacgtaactgaacaaaacgcaatcgatcagcttttaatcgagcttgacggtactgaaaacaaaggcaaactcggtgcgaacgcaatccttggcgtatctatggcttgtgcgcgcgcagctgctgatttcttacagattcctctttaccaataccttggaggattcaactcaaaaacgcttcctgtaccgatgatgaacatcgtaaacggcggagagcatgctgacaacaacgtagacattcaagaattcatgattatgcctgtaggcgcgcctaacttccgtgaagcgcttcgcatgggcgctcaaatcttccacagcctgaaatcagttctttctgctaaaggaatgaacacagctgtaggtgacgaaggcggattcgctccgaaccttggttctaacgaagaagcgcttcaaacaatcgttgaagcaatcgaaaaagccggcttcaaacctggcgaagaagtgaagcttgctatggatgctgcatcttctgagttctacaacaaagaagacggtaaataccatctgtctggcgaaggcgttgtgaaaacatctgctgaaatggttgactggtacgaagaaatggtttctaaatacccaatcatctctatcgaagacggacttgacgagaacgactgggaaggccacaaacttcttacagagcgtcttggcaaaaaagttcagcttgtcggtgacgaccttttcgttacaaacacgaaaaagcttgctgaaggtatcaaaaacggcgtaggcaactctatcctgatcaaagtaaaccaaatcggtacattgactgaaacattcgatgcgatcgaaatggcgaaacgcgcaggctacactgccgttatctctcaccgttccggtgaaactgaagacagcacaatcgctgacatcgctgtggcaactaatgcaggacaaatcaaaacaggtgctccgtcccgtacggaccgtgttgcgaaatacaaccagcttcttcgcatcgaagatcagttggctgaaactgctcaatatcacggtatcaactctttctataacttaaataagtaatgtaatggacgccgggagaatatctcccggcgtttttttatggtcccgggcttttccctcctttttcatcatcttcatttggtcaataatattcatttttcccctttttaaaggaatcagtgttcttcaatcgaaagggaagaggtgttaataagaggagggattatgatgaaattttcatttatgtcagccgcggtggcagcaagcgtcatatggggcgcgtctgccgggccgctgtccgaaactcatgcttattcaactgtgaccgcgccggtttttgatgctgatgaggcattggacactatgcatgatctgagtgaaaccatcggtccgcgggaaaccggaactgcgaaagaaaaggaagcggctgaatacatatcgaatcgtctgcgggctcagggcgccagtgtcaaagtacagtcatttccattgaaaaagtacttttcaggttcagtcacagcgggagatcatgaattcccgctccgctccgctgatcaatccgctgttgaaaaagagctcaaaatagaaggcgggatttttgacggcggctgcggatcacgcaatgacgtaacaggagccgaaggaaagattgcagtgatacgcgaaggaaagatccctgtttctcaaaagatcaaacatgccgaacaagcgggagccaaagcagtcattatttataatcagacaacaaaaccgctcgccgtccgtccgcataccgataaaggaatcacgataccggcggcgggtatgaaaaaagaagacggtgaagcattgcttcaggaaaagaaggcagtcattcaatttaaaaactataaaaaccgcacctcacaaaatattataggaacgcgcaaagcggcacaggccaactcttctgatgctgatattatttatgtcacagcgcattatgacagcgtaaaaggcgcgcccggagcggatgataacgcctcaggcacatctgccgttctggaaatcagcaagcaactcaaacatataccgaaagacaaagagatccgctttatcctgttcggtgcagaagaattatggtctgcgggttcatcttattacgtcagtacactcacgaacaatgaaagaaagcacagccgggccaattttaatgccgatatgattgcgactgactgggaagaagcgagtcaaatgtgtgtcacgactcctgacggcaggaaaaacccgagtgtccggtatgctgaaaaagccgctgaaaaatcccggttggtcaagccaaacctgattcagctcggttactcagaccatgtctctttttatgaagcggggattccgtcggctaactggatttggctcagccccgatacacaggagccggggccctggtaccacaccgaaaatgataatatgaaacacatcagcaaagaacggctagagaaagctggagcactcgtttccgcggcagtaactgaggcaatgaaggaataaaaaacaggcttcggcctgtttttttatattattttctgtatattctatcaattaagggagattttctcactcgttaccagatatataccatttaacaggattttattttacaaataaaagaaaaataaatagataatacctaattcacaaaaggatgtaaaactcatttatcaaattttaacttttgttataattgcgatatcgatcgatatttgttttaaattgtaaaaaacaatactcttttctatctattagggggcgaaaaatgaatactgtcacaaaagaagccagcaaccttggtcaaaaacggctgttacatctgattgaaacgaagcaggcgatagtaggcgtgttaggcatgggatatgtgggatttcctcttgcgctggaatgtgtcgataaaggatacaatgtgatcggatttgacaaaaacagtgaaaaggtttccttgttagccgccggaagcagccatattcaagatatagaggacggcagactgaactcggctttacaaacaaaacgctttcaaatcagtgccgacatgtcgctcatccaaaaatgcgacatcattgtgatatgtgtgccgacacccctgaacaaaaaagacaagatccccgatttaacctacatcgacagtgcagttgacagcatgatcgcttatggaaggcagcatcagcttttaattttagaaagcaccacctatcccggaacaacgaaaaaaaagattgccgacagaatggcatcaagccgcggcatgaaaataggaacagacttttttacggcttattctccggaaagaatcgatccgggcaacaggcaatatgaagtttcagatattcctaaagtagtcggcggaaccacacagacttgcacagaacttgcctcagcgttttacaacaccattgttacaagcattcacccggtcacctcacccgaagtagctgaaacagctaaactcctagagaatacttatcgttatgtcaatatagctcttatcaatgaaatggcgcttaattgccgtgaacttgatattgatatatgggaagtcatctgcgcggcggacacgaagccgttcggctttcaaaaatttatccctggccccggagtcggaggccattgtatcccgattgatcctttttacttcaaatggatcgcgaatgaaaaagggctgcagacaaaattaattgatctggcggacgaaatcaattctaacatgccgatttctgtctctgactatgctttgaaactggcgggcaaagacaaatgcagcatcttaataataggggccgcttataaaaaaaatacaaatgacccgcgtgaatcctcagtgtttacgataatggaagaattgatggacaagggatgcgcgattgattatcatgatccgtttatcagcgagatccgcttgaatgacggaagccgcaaacaatctgtccctttcacaaaagaacaaatcaatcagtacgacgtcatcatcattcatacagatcacgatgtaatcgactacagtattttgaaggatgcctcaccgattatctttgacacaagaaatgtatgcagggaaaaatcagccgacaattgcagagttgtcactttataggagggaacggtcattagtaatcgatttatctcttttcacagacctgatatgacaaacgaagaaatcgcaagcgtaaccgaaacgattcagtcgggctggatttcgaaaggcccgaaggtaatcgattttgaaaaaaagctgggagaatgtattggagccgaacacgtcatcagctgtaattcaggaaccgctgcattacacatggctttattggcgctcggtgtgggagaaggcgatgaagtcatcgtgccgagcttcacgttctgttccagcgtcaatgtcatcctgcacgccggagccgttcctgtgtttgcggatatatgcgagaaaagtctatgtgccgatcctgaagatgtcaggaagaaaataacgccgcgcacaaaagcggtaattgcggttcattttgccggctatccggctgatctggaaaacttgcagtccatttgtaaagaaaacggattgtatctgattgaagacgccgctcatgcgctcggtacaaaatataacggaagcatgatcggcactcacggcgatgccgtgtgcttcagcttttatgccaccaaaaatattacaacgggggaaggcggagccctcgtcatgaaagacgaacaggccgcagaaagagcgaggctgtacggctggcacggcatcacaaaaaatgcctggaaccggtacggtgaaaaaggcagctggagatacgacgtgttactgccgggctttaaatataatatgacggatattcaggccgcgctcggtctggttcaattgaagcgcgcaaacgaaattcaagaaaaacgggcacagatcgctcaattttatgtacgtgaactgtcgggccaatctgacaaagcagcgcttccgctttctgacattccgaacggcataacgcactcatggcatttatttattttgcggatccgagagaacggcggcatggacagagatctgtttattgagaaaatgaaagaaaaacagatcgggctgagcgtgcactttattcccgtgcatatgcatccttactatcaaaaacattttccggccgagctgccggttactgaacgtgttttccgggagatcgtgtcactgcctctttacagccagttatcagatgaggattgcagctatattgtcaagtctataaaagaagttttgactatcagccaggaggtaggatcatgaaacatattgcgattatcggaggagccggttttatcggaagcgaattggcggcattattacaggctaaaggttatcacaccattattgcagaccaaaaggagccggcttttgacactgaataccgccaaacggatatccttgatcggacgtccctccgcgaatcactgcggggagcggatgcggttgtccatttggcggcaatggtcggtgtagacagctgccgaagcaatgaagaagacgtcatacgggttaattttgaaggaacgaaaaatgtcaccgaggtatgcggtgaattgggaatcagaacacttcttttctcatcgagctcagaagtattcggagattcacctgattttccttataccgagacaagcagaaagcttccgaaatcggcttacggaaaagccaaactgcaatcagaggaatatttgagagaacaggcttccgacaagcttcatattcgggtcgtccggtactttaatgtatacgggccgaaacagcgcgaggattttgtcatcaacaagtttttcagcctggccgagaatggctctgagctgcctctttacggggacggcggacaaatacgctgcttcagctacatcagtgatatcgtcaccggaacttatctcgcgctcattcatgaaggagccgtctttgaagactttaatatcgggaacgaccagccgatcacgataaaagaactggctgaaaaagtcaatgtgctctctggcagagagaaggataactatctgtttaaaaagctgggcgaagacggcgtgaggggaaaagacatcgagatttttaaacgggcgccgtcaatcgagaaggcgaaacgtttactcggttacgatccaaaagtaagtctgaatgaaggcctggagatcataaaagatgaaagacaaaagcacaaactttcactttcctgaaaacccggaagtagtcaaatatcccgtttatcccggacagctttccgtcagggaccgtctgcgcgcggtgaagcacttgcttactggcggacaaagcggactgactgaaaaactggaaaaacggtacggaaaaggggttgtgctgacctccagcggcagtgcggcactggtgctcgccttaacttattcgggagccgggccggggaaagaagtgattttctcatccttcagctgcccgaatgtcattgatgccgtattgcaatccggtgcaacgcctgtttttgcgcagctggatgagcatctttctttatcgtttgaggatgtcaaaaaaagagcgacgcggcagacgtgtgcggttatcctcacgcacgtatacggccggagagaaaataccgccatcattgactgggcgaaggaacacggtatttttgtcattgatgatgccgctcaagccatgtttacaaaacaagcggatacatatgccggcggtctgggcgatttcggtgttttaagcttcggcccgtcaaaaccgcttgcgagtatcggaggcggcgcgttaatcgcgccgaaagaatggcttcggcaaaaagcaaatttcccgatggaacagcgcagccaagtggcagctgactatcgaatttatatcagaaatcaaagaatacaggctgttatgaaacggaaacggcatcatcccgtttcatatatttataggaaagcgggcatcatgccttccatgaaagccactaagctcgaagctctgccggataaaccggctgttgtaccggtgcttcgcatgcatccggcaagggaagccattattgaagatcagctttcacttatggatcagcttgtaacagcttcgctccgaaacttacaagcggcgggagaaatctttataaaggcggaagagacgtacggcataaagatgatccagccccaagaaggagaacatctgaattatttaacgattgtattcccccgggatgaagagcggtacgggtgttccgtttatttagctgaaagaggcatccaaacatgctggaactatcttcccctcggacgtattccgatttatgaaacatatgcggcggaagaaggggaagatccgctttggaaaagagttctttctctgccgtttaaacctcctcttcaaaaggagcaagtcagatatatagccgaatccgttttatcatattgtgagcaaaagaataagactgaatagtggtgataacaatgcaaaaaacagcagtatgcacgagccgccaggcatgggatcgggccgctgacatgtatcaggcggggttgtttcaaagctatgattggggaattctcatggaagagcttcccggcacgtcatttcaccctgtcagactgacaacggacggaggacaggtcatctatcttccgctttttgaacagaagggcgtattatccggcaatatgatcggatacggcggcgttatttcagatcgccccatctcatttgaatggcttcaaagtgaaatcgaggccatattcggccggaacatatcccggatgctgctgccgtacggtcagacttcttttacagaagaaatcggggaagggtggacggaaaaggcgacacggattcttacgcttccggacacgtttgacgaactttggacgggcatttccggaaaagcccggacggcagtcagatacgctgaaaaagagaatattgtcaccaggctgatcgggcgacaagaacttgaatcattttacgacctctacaaggagcatacggcggcaatcggcgctgcttatgtgctgagccaaggatttttccaaaaactgcttgacacgtttggggaccggatgttttgggtcggagcatatcaggatgagacgctgatcagcagcagtatttttctctatgaccgctctcatttctattattggcagaatgtaaacagcctggcgggaaaaaaagcgcaggcctcttacttgttgatgcgtgacgctttgcaattcgccatttgccgcaagcttcaatgggctgattttggctattcacacagtaaagaaatcgcaagaccgaaacgatattggggagctgaagaaaaacaatgccgactttttacgaaaccggaatgaaaacaataagcggccatcaatccagttatctgccgtggtacggtttttttgaaaaaatgtataagtcggatctgtttgccattcatgacacggctcaatttgagaaaaaagggtttctgaaccgcaacagaatcaaaacgccgcagggccccagatggctgacggtgcctttgcagatgaaacaatataaagacatagagcttcggcatatgaaaatcgaccagacacaggattggcggaaaaaacattggatggcgattaagatgaactatgcgaaagctccctattttgagcggtaccagcatttttttcaagatgtctatcagagggagtgggaatatctccatgatttgaatatgcacatcattgaatttttccgaaaagagctccgaatcgaaacgccgctctgttatgtctctgagcttgaatgccggaaggagaaaaaaagcgattttgttttagcgctttgtcaggagctgggggcggatcgttattattcaggcagtcagggttccgactatttaatagaaagcgattttgaaagaaacggaattgtcattgagtatcagcagatccggcattttgactatcctcaattattcggggagcatatccctcacctctccatgcttgatatgctgatgaactgcggagcggatacagctgaaatgttagttaaaggagggcaatatgatgaaagtaatggtatttgcagcgcatcccgacgatgaaattatcggcgtcggcggcacgctcgccaaacatgtccgccaaggtgacagcgtgtcggcagtcattatggcggaaggcaagtcatcaagaaaaacggattatgagaagcctgaagagtctgttatgcagcattctgctcaagaaacggaacaagcgctcagcactttgggcatccatgattttgtcaggctgaaccttcctgataacagaatggattcaatggatttgctggatgtcgtgaaggaagcggagaaacaaatcaatcgttttcagcctgacattgtgtatacccagtacggcggtgacattaatattgaccactccgtcgtattcagagcggtcatgaccgcaacccgtccgcttcccggccatacggtaaaacgggtttttgcctatgaaacattgtcttcgacggaatggaattactgtcagaaggatcagtttcatgccaatttcttcgttaatattgaagacgagcttgaaacaaaattgaaatcgatggcgtgttacggctccgagctcagagacttccctcatccccgctctttgcaggcaatcgaacataatgcccgtgtatggggagcaaaatcgggtttttccgctgcggaagcgtttatgcttgtgagaggaacatggtgactgtcctatgattgctcaaattccgtttttcggacttgatccgaagcaaatcgatgagaaatgggtggaagcgggatacggtctggaagcgaatatttttgacggccgctcctttagtgaagcggattatctcaaaacattcaatcagacgctggaatatgcaaaacagcttgatccttcattattgacgctgcatttcccgacagatcatgccgattatgtgcatgaagatcacatcaaaaaacagctttatcactttgcggagctcgctgtgaaatacggcgccaaaggcataaccgttcatgcgaatcaatttatgacggttgaggaatttcaagtgtatgacctggaaggaaaccgtaaaaaaatcattgagtttttcgcagagtttgatgagcagctgaaagggacggacatttggatcggtgtggaaaaccttccgatcatcgggaatctgggagaggattttgatccgattttcatttatcctgaggattttacagagctggttcagctggatctgaagcatgtcggtattacgtgggatctgtgccattgggcgattacctatcagactcacttgtcttccgcgcttatgttcagaaatgaccagctgagatacccggatttctttcagtttctctcgataaaagagagcattaaacattatcacttcagctcatttcgccagcttgcgttcccgcatggcggcgtccgctgttttgagggccgccatccgagtgaagggacgatcgctgaggagctgctgagacgggctgccgatactttgcaggagctttatcggaatcaagataccggcattgtatttgaggtgatggaagaggattatacggaaagacgggaatcatggagaacgctggaatggttcggcggtgtttctgatgccgaggatcaaaaaagggcctgatatgacatatcgaacaccgaactatgcaaagctttggtgtgcgcaggtgttttcttcagcggcggacggtatctggcttattgcactgccgctgttagtgctggaattgaccggcagtaaaattcttgtcggcgttatttcttttatcgaactcgtgccgttgacatttggcgtgctggcgggaccgctgattgatttattccgaaaaaagtcgatcttgtatttgtgcaatacgggccgggccgtcatcatgatcctcttggcggtgctcagcgcgaacgatttattaaccgtgtggatagcaggggtgtgcgccttttgtctatctctgcaatcgatgctgtttgcgccggcgaaagtcgcgatcattccgctgctcgtccgcaaacagcatcttgatcaggcgacatctctgatcaatacgagtgacttgatcggactcatcgtcggaaaactgatcagcggaatcatgattgcggctattccgttcgggctgctgtttgccataaacggaactgctttttttatctccgcggcatttatcgcgttcattcgtatttcagaacagcccaatgaaaaaagcaacggggctgaagatgtaaaagccggctacagaatgctgaaaggaaatgcggcatggctgacatcggtcggatactttttcgtcgtaaatctcgtcattgccggtcttatttcagtaatggggccgattcttgctgtggaacgttttcagcagaactattctgtatggtttgccgtcatgtattcaatgtttcaggcggggatgcttttgggcaatctggccgtatttttcaaatggaatacaaaacgcttgaaccggctgtatccgcggacgttaacggcagcgggactgctcattttggtgctgttttttccgcttcacgggtttgagtgcatcattttcctggtgcttggcatcatcatctcgtatattgatgtgcaaacggtgctgtatttccaaaagacggttccggccgcatatttcggaagggtttttgcactgattttttccattgtcaaaatgggtgaaccgctgtctgccgctgtctacacagggcttctgctgttgatgaatgcggattatatttttgcggcggtcggactgacccttacgatcgtttttgctgttttttcagtcagacaagggagtcaaagaaattcagagaaacaagcggatcaatccgtctgaatggtaaacgaaggtgcgccggtatcagccggcgccctttttatcataaatccaaataaagccgtatcatatccaggcattgaatgccgttttcaaaaatgtcttcatcataatgtctgataaaaaaatcatggtcgacagcctgaatgcggaatccgcatttttgatagagtgacagctgatgaatactggaatttccggtgccgatttcaatcgtgtcagctcccgattgtctcgctttttcaatggcatcttgcaccagctgttttccgaatcccctgttctgcagcgattcttttaccgcgatgtttacgatttctatcgttttaggccttgtttgcaataaaacgtaaacccctgcaagctcgtctgacgtccaagccgtatagcattctcctcttacaagataatcatcgacaatctctttcgacggatcggccagcagcaatagttcatacagcgcttcatccggatccgcggcttttcggatgctcagtttttgcatgtccgtttctcctcctccgttatgatcgacagctatttttcaaaataactccaaaatcattctactttattataaaatatgaaacataggaaaagttatacaagttttgtagattgaataggaggaaagtcatgtttttttgtaagtattgcggccgacagaacaacgaagaggcgcatttctgtaaagaatgcggaaaaccgatcgggaaaggaagccggcttgaacggcaggcggctgtaagagcggctgaacctgcttcacaaatgagaaagccgatccctaaaaaaacgctcttcatatggggcggcatagccgcagcgctgatcttattgattgccgcatataaaaccggagcctggctgacatctgaaaaaaggctcacggatcaattcgaacaggcggttcatgacggggacacgaaaaagctcgcagccctgctcactccttcagacaaaaaactgaagctgaatgagaccaatgtcaaaccgctccttgcatacgcaaagaaacacgatgaactgctggaaacgcttcgcggcaattcatcagaaaaagatgcggtatacgtcaaaaaagagggtaaaacccttcttttgtttgaccattacgaactgaaagtcgatccggtttatttccgcgtcaccagcaattataaaggcgccgatctttatatcaacagcgagaaaacagggacggtcaaaaaagccgatgaaacccaaatcttcggcccgtatgcacccggtgtctacacggcggaagccaagcttaaaaatgacacggttgacgttgtcaaaaagcaagaggcagaggcggccggcagccggaatgttgattttgatctgccgttagacgccgaggatgtgacgttcactccggcagacagcttcaaaagcgcgaaaggcgatctgctgataaacggcaagtccgtccataaagatccgtttacatccgttacatacggtccgctcttaactgacggttccatgacagccgccgtggaggctgattttccttggggaaaaatgaaaactgccgatgttccgatcaacggtactgatatggaattaacgcttatcccggatcaagatacacaacaaacaatcatggacacgattgtcaaaacaacgaagcagtatacaaaagcgatggcagacggaaataccgatcagatgaccgaggctggttccgcctggaaagagcagacgaaagaagtggtatccggcatgaagagttccggcacctttttgaaagatcagtataaagagacaagctttgatctggattcatttgcgatttctcaagagaacggccgctggcaagtaactgttacgggtaaagagcttcatgagtctgcttatttcgacgggaatacgaagcctgatatggaagaggctgagccgagctttcattatgtactctcatatgatacaaaacataaaaaatgggtttttgaaaaagctgatccagcctcagattcttctgggacaaatgtaaaaaaaataaaaaacgaccagccgaaaacctatacatccgcatgggcatcttccaaaggaaatacagcttcaggcagcgtgacaaacgagcaagtcacatcgtttatgactgattacctgacaaatcaatcaagcgccgtcagccttaacaattttgccatcatggcgggcaatttagaagagggaagccctttgtatgctgatcagcagaaactggtcaaaaaactgtacagcgaggggacgactgaagtatttaataaagtgaatgtcaaaagcttttcacagaaaggctctcatctgacgattcatacgtacgaggagttttatattacgaaagccggcggcagtccgaagctcagaacatacaattggacgtatggcggcgttgtcaaagacggaagaatttatttaacatccattcaataaaaaaacccccgcgccaatcaggcggcgggggtttccgtttttaaaagaagaaataattcatgagttctttcatataatgcttgatcgtgaattgaaacgttacgcaaatgatcaaatagatgacgataacagaataaatgatatccgccttagcagtgagctgatgctgatagctcgccagcatgagcggaggcacggcaaacgccgctcctaaaagaccgacagccagaatggtaaagcaaacggttgtatgaagcagcataaaaatgagggcaagaagcaaaatagctgtaaacggaatcaaaaatgctccgaatctggacagcgaatctttaaatgacacctgcgcgccgccggccttcaaagcgataaaaatcaagagatacaggcagaaaacgcataatgcaaaggtaagcgccggtttgatcacaaccgcggtaaaactgacgtcacgaaagccgtctgataagagaatataaaacataatcggcgtcaccaggcagaaaagcaccatgttgatgatgctgctgacaagctgttcgccgcctgtcgttttacatgtttgatacggtctctttaacacatcaagcacgaataaggcaaattgctttgaagcctgcttagccgcggcgccggcctgagcggcctgaccctgtgtttggcctgcgcctccctgcccgggctggggcgcaccgcatttttcacaaaattttccgccatcagtatgatggccgcattgagaacaatacattctaaaactccttttacaagtaatatagggattttgttcaatatttacattataaaagaaaataggacggatgtaacggagttttctaaagatatataaatcaccttctctatgaattgataatagagaaaaagtacccattatggtagaattttattggagctgatagatatcatgtctctcggcgcattgattcagagtgaaaaaggaaattaacgcatgctaaaaaaattgaaaatgctttatcggctgttgaaattcggaaaaggcttatggagatagcaaacagaaaaaaaccgtccttacaaggacggtttttttctgttttccggatcgtccggctgaggttataaaaagcagaccccggggtaaaaatcatgcataagaaacagcggagaacaaaacataactcaataacggcaagtcataaggaggtacgcatgttttcattcatcattcatgtcttcatttcactgtttgcagtctccaatcccatcggaaacgtgccgatttttctttcactgacggaaggatacccggagaaagaacggacagcgatcgcacgcaaggcttccgtgctgtcgtttatcatcttggctgcttttttaattttcggccatctgatctttaaactgttcgacattaacattcatgccttgcgtatcgcgggcggcatttttattttcggcatcgcttataatcttctgaacgcgaagaaatctcatgtacagtctctccatcatgaagagaaaggggagagcaaggagaaagccgatatatccgtgacgcctttgtcgattccgattatcgccggacccggtacgatcgcgacggtgatgagtctgtcggccggccatggcggcatcatccattacatcagcgtgcttatcggcattgcggccgtcatcgcgatgacgttcatcttctttcactattcttctttcatcagcaataagctcgggaaaaccgaaatgaacgtcattacccgactgatggggctgattttggcggtggtggcgatcggcatgatcggcgccggtctgaaaggcatgttcccgatattggtttcctgacttaaaaaagcagcgcccggttatcttcgggggctgcttttttctattttcggcacatgctgaaacacttcttcactctcaaaaaattctatcaaacggctcagccagtcataataatggagccaatccgtcagttcatccaaaagctgacgggctttttcttcaatatcgggactgagattttccgattccagaagctcagtcagctcgcggttcagctttttatagagcattttgtttttgctgaccgcctttgtccaatttgccgtaaacagggagataaacgtctggtaataatcacgctccacgtcgtaaaggtctttgcgaacgcctttttcaaacactttttccgccagattggcatcagtcatttcacggaccacctggctcatcctcgttttgctcatcccggttgcctctgacagctcatttaacgtcatcggcttgcggttcatataaataataccgagcacacgaccaagtgtggccggcattccgaatgtatgcatattctcggcgattctctcaatgagatgctcttcagcatgcccgatgatatcaagagcgtttttttccacggctgatcatcccttcactggcttttcatgctgacaatatatcatattttttacagttgatgaaaaagatgatgcggcaggatatgcgagctatcgggagcgattgtaagaacatccgcattgtcagcgggataacatgaaaaaatacgtatattgtatataatttcaacacattgtaaactttttattttacaaatttcatcttataataaagattatacttttcagaaaaataacggaacccttcggaggtgcacggattgctgagattagaaaatgtatcgaaagtctataaaggcggaaaaaaagctgtcaacagcattgatttaaatatcgaaaaaggcgagtttatttgttttatcgggccgagcggctgcggaaaaacgacgacgatgaaaatgattaacagactgattgagccgtcatccggaaagatttttatcgatggcgaaaacattatggagcaggacccggtggagctgagacggaaaatcggctacgtcattcagcagatcggacttttccctcatatgaccattcagcagaacatttctctcgtgccgaaactgctgaaatggccggaacaaaagcggaaggaacgggcgcgggagcttttgaagctcgtcgatatgggcccggaatatttagaccgctatcctcacgagctgagcgggggacagcagcagagaatcggcgtgctgcgcgcccttgcggcggaaccgcctcttattcttatggatgaaccgttcggagcgcttgacccgattacacgggattcccttcaggaagaattcaaaaaactgcaaagaacattgaataaaacgattgtgtttgtaacccacgatatggatgaagcgattaagctggctgaccggatcgtcattttaaaagcgggagagatcgttcaggccggcactcctgatgacattctccggaatccggctaatgagtttgtcgaagaatttatcggcaaagaacggttattgcaatcaagaccggacattgagcgcgtcgagcagatgatgaacaaaaagcctgtcaccgttacggcggacaaaacactttcgcaggcgatccaagtgatgcgggagcaccgtgtcgattccctgcttgtcgttgatgacctgaatgtgctgcaagggtatgtcgatgtcgagatcattgatcagaaccggaaaaaagcgagcctcgtcggcgacgtgctccgctctgatctgtatacggtcgagcagggtacactgctgcgtgataccgtacgcaaaattttaaagcgcggaatgaaatatgtacccgtcgttgatgaacaaaggcatttagtcggaattgtcacgcgggcgagccttgtcgacatcgtttacgattcaatctggggcgaggaagaccagctggtgacaggctgacaaggggaggaacgcttacaatgaatgaaatgatcaagtttttgcagacgaacggcggagaactgttatataaaacgtgggagcatttatacatttcgatcatcgccgtcatattaggcattgtcgtcgccgttccgctcggagtggcgctgacgagaatgaaaaagggcgcaggcgccgtcatcggcgccgtcaacattgtgcagaccttgccgagtctcgcgatactggcgttttttatcccgctgttaggcgtgggaaaggtgcccgcgatcgtcgcgctgtttttctattcggtgctgccgattctccgaaacacgtataccggcattcaaggcgtaaacaaaaatctgctggaatcgggaaaaggcatcgggatgacggtctgggagcagatcaggcttgtggaactgccgcttgcggttccggtgattatggcgggcatccgcacatccaccatttatctgatcggctgggcgacgcttgcttcctttatcgggggcggcgggctcggagactatatttttatcggcctgaatctctatcagcctgaatatattatcggcggcgccgtgcccgtcaccattttagccattatcattgattatctgctggcggcgacggaacggaaggtgacgccgaaagggctgaaaggactgaaggaagtatcataaggagttggctgttttgaaaagaaaccaaaagagatggatgtgcgcactggcgctgtcagctgctctgcttctgggcggctgttcccttcccggcctgagcggggcttccgatgatacgattaaaatcggggcgcaaagcatgacggaatcagaaattatcgccaatatgctcgcacagatgattgagcacaatacagacttgaatacggcattaattaaaaacctcggatcgaactatgtccagcagcaggcgatgctcggcggtgaaatcgatatcgccgcgacgcgctactcgggaacggatttaacgagcaccctcggcatggaagcggaaaaagacccgaaaaaagcattatctatcgtccagaaggaatttgagaaacgcttccattacaaatggtttgattcttacggatttgagaacacatacgcttttaccgtcacgaaagagcttgcggaaaaagatcatttagacaaagtatccgatattaagaagcatgcggatcaatttaagctcggtgtagacaatgcgtggctgaaaagaaaaggcgacggctataagggcttcaccgacacgtacggttttgaattcggcacaacctatccgatgcagatcggacttgtatacgatgccgtgaaaaacgggaaaatggacgccgtcctcgcttattcaacggacggacggattaaagcgtacgatctgaaaattttaaaagacgacaagcagtttttcccgccgtatgactgttcgccggtcattcccgacagcgtgctgaagcagcatcctgaactgaagggcattgtgaataaactgatcggcaaaatcgatacggaaacgatgcaggaattgaattacgaggtggacggcaagctgaaagaaccgtccgtcgtcgctaaagaatttttggagaaacatcattattttgaataagaaatgaggtggggcaaatggaagtgctgcagcagctcggcacttattattctcaaaacggggcctatgtgcttcaggagttttaccgccattttctcatgtcggtatacggcgttttatttgcggcgatcgtaggtgtcccgctcggcatcttcattgccaggtacagaacattaagcggctgggtattcgcggtgacaaacgtgattcagaccgtgccggcgcttgcgatgcttgcggtgctgatgctcgtcatggggctcggcgccaatacggtgattttgtcgctgtttttatattcgcttcttccgatcatccggaatacgtacacaggaatcgccagcattgaacacgcttatcttgaatcgggaaaagcgatgggcatgaccaaatttcaggtgctccgcatggtggaactgccgcttgcgctttccgtcatcatggcggggctgcggacggcccttgtcatcgcgatcggcattacggcaatcggaacgtttgtcggcgcgggcggactcggtgacatcattgtcaggggctcaaacgccacgaacggaacagcgattattttagccggcgccattccgacagcgctgatggccgttatcgcagatcttgtgatggcatggctggagcgggcgctgagtccggtgagaaagaaaaaacgaaccaaagcgccgaatgcggcatgaaaaaaacgccttgcgggtcagggcgttttttttcttatggcttcggaacatgcttgaatatttcttcgctttcaaaaaactcgatcagacggctgatccagttgtagtaatcaagccaatcctttaattctttcagcagttcgttgattttttcctcagcttcttccggcacgccgttttcaaggacggccgtcagttcgcggttcagttttttatgcatcattttatttttgctgacgaccttgctccatgtggccgtaaacagcgtaataaaggtttggtagtaatcctgctcgacgtcgtataaatctttgcggacgcctttttcaaacactttttccgccagattgacgtcaagcatttcacggaccgcctggctcattctcgttttgctcatgccggtcgcttctgataattcagttaaggtcatcggcttgcggttcatataaataatgcctaaaatgcgccccaccgtcgcgggcattccgaatgtatgcatattttcagcgattcgttctatcaaatgatcttcagcttgttcgattacgtgtaacggatctttctccaacagtttcaatcctttcagtcagcaattccgatgtcaatataccacatttttaaaccggcggaaatgctcttccgagagaatttggcagtaattcggagcaataagaagaactttgccggtcaatacgggtaaatcagtgcttacacaacctttatatataatatggacaaattgtaaactttttaatttacaaagtttaatttataatgggaaacgttcaattgtctgaaaagttaaatttgaatttaacgatttgaacaaatttaatatcggaggtgtgagtgtttgctgacattagaaaatgtctcgaaaacgtataaaggcgggaaaaaagccgtcaacagcatcaacctgaatatcgacaaaggcgaatttatttgttttatcggaccgagcggctgcggcaaaacgacgacgatgaaaatgatcaaccgcttaattgaaccgacagaaggcagaatcctgatagagggccgaaacattatggaacaagacccggtggaactcagaagaagcatcggctatgtcatccagcagatcgggctgtttccgcatatgaccattcagcagaacattacgctcgttccgaagcttttaaagcattctgccgaaaaacggaaggaacgggcgcgggagcttttaaagctcgttgatatggggcctgaatatttagaccgttaccctcatgaactgagcggaggacagcagcagcgaataggtgtattacgggcacttgccgcagagccgccgcttatcttaatggatgaaccgttcggggcgcttgacccgattacgagagattcccttcaggaagaatttaaaaaactgcaaaaaaccttacataaaaccatcgtatttgttacccatgatatggacgaagccatcaagcttgcagacagaatcgtcattctgaaagcgggagaaatcgtccaggccggaacgcctgatgagattctcagatttccggcgaatgaatttgttgaggagtttatcggcaaggaacggctgattcaatcatccagccctgatattgaacgggtggagcagatcatgaatcccgatcccgtgacggtaacacctgagaaaacactgtcagccgccattcagctgatgcgtgccgagcgggtggattcgctgctcgtcattgatgaaaagaacgttctccaaggttatgtcgatgtggagatgattgaccgcaaacgaagacaagcggtaaccgtcgcggaagtgcttgaacgggatctgtacacggtcagaagcggcactctgcttcgcgacgccgtccataaaattttaaaaagaggcgtgaaatttgtgccggtccttgatgaggacggccggctaacgggaatcgtgacaagggcaagcctcgttgacatcgtctatgactccatctggggagaagagaatcagctcgcggtgatgtcatgaggaggcttcaattgatatgaatcagaccgtacaatttttacaggcaaatggaggagagatgctttataaaacatgggagcatctgtacatctcattaatcgccgtcatggcgggcattctcgccgccgttccgctcggcgtcctgctgacgaggatgaaaagaggagccggcgccgtcatcggcatcgtcaacatcattcaaaccttgccgagccttgccattcttgcgttttttattccgcttttaggcgtaggaaaggtcccggccgttgcggcgctgtttttctattccatgctgccgattctcagaaacacgtatacggggattctcggcgtcaatcggcaccttctggaatcgggaaaaggaatcggcatgacggcatgggagcagatcaggcttgtagagctcccgcttgccgccccggtcatcatggcgggcatcaggacgtcttcgatttatttaatcggctgggcgacgctcgcctcctttatcggcggaggcgggctgggagattacatttttatcggcttgaacctttatcagccggagtatattatcgcaggcgccgttccggtcacgatgctggcggccgccgtcgattacatgctgggggtgacagaacggaaagtcacgcctgacgggctgaaaagcataaaggacgctttataaggaggaggtctcacatggggaatagatgcaaaaaacggctgctcgcaatcgcctgtctcggcatgctgctccttggcggatgctcgctcccgggattgagcgccgcatcggaggacaccattaaaatcggcgcgcaaagcatgaccgaatcggaaatcatcgcaagcatgctcggacagatgatcgaacatcacagcgggttgaaaacatccgttattaaaaatctcggctccaacgccgtacagcagcaatccttgatcaacggtgatattgatatcgccgcgacgcgctatacaggagacgcgctgaccgggacgcttcgcatggagccggaaaaagacccggacaaagcgctgcggctcgttcagcgtgaatttcaaaacagatatgacatgaaatggtttgattcttacggctttgataatacatacgtctttaccgtttccggacagcttgccagcaagtaccatttagaaacggtatccgatgtcaaaaaagaagcatcccatctgaaattcggcgtagataactattggatgaagctgagaggcaacggatatcaggattttatgaaaacatacggaatgtcatttgaaggcacgtatccaatgcagatcggcctcgtatacgacgcgctgaaaagcagaaagatggatatcgcgctcgcttattccaccgacggaagaatcatcgcttacggactgaaaacgctgaaggatgataagcggttctttcctccgtatgactgttcacccgtcgttccggatcatgtattaaaagagcatcccgaactggagggcgtgatcaataaaatgatcggcgcgattgatacaaagatgatgcagaaaatgaattacgaagttgacggccgattaaaagagccgtccgtcgtggccaaggaatatttagaaaaacatcattactttgaataacggaaaggagatgtgcggatggacacgatgaaagagttgtttacgtattacgctcaaaacggcagctatgttctgtatgagtgctggcggcactttctcatgtcggcgtacggcgtcgttttcgccgccgttttcgccattccggccggaattgtgacagccaggcacgggcgtctcgccggctgggtgtttgctgtggcgaacgtgattcaaaccgttccggcgcttgcgatgctcgccgtcctgatgcttgtcatggggctcggcgccaatacggtcatcacggctttgtttttgtattcactgctgccgattctcagaaatacgcacacgggcattatcaatatcgagcacgcttatctcgagtcgggaaaagcgatgggcatgacgaaataccaaatccttcgtatggtggagctgccgcttgcgctttccgtcattatggcgggtctccgaacggcgctcgtcattgccatcggcatcacagcgatcggcactttcgtcggcgcaggcggtctcggggatatgatcgtcagaggctcgaacgcgacaaacggaaccgccattattctggcgggcgccattccgaccgcgctgatggcggtggccgcagacctgctgatggcgtggctggaacgagccctcagccctgtgaaaaaacaaaaaagaaagctgatcgtacgctcagcctcatgaaaaaaagcattcttccgcgtgaaggatgctttttttgatttcttgattaaattttgataactgcgctgtaaagtcttacatatcaaataacaaagcagaggggtaatcatatgagcaacatcatagaaacgagacagctgcaaaaatcattcggcagacaacaggcagtggctgatgtgtctctatcggttaagcgcaacagtatatacggcctgctcggtccgaacggcgcgggaaaatcgacgactctcaaaatattgaccggcatgctgcagcaaacatccggcgaggttctgttcgagggacatacatggaagcgcgaagatttgaaaagcatcggttccctgattgaagcaccgccgctttacagcaacctgacagccgctgaaaatctgaaagtccgctgcgtgatgctcggactgcctgattcaagaattgcggaggtgctggaaattacgggattaacgggaaccggaaaaaagcgcgccggacaattttccatgggaatgaaacagcgtctcggcatcgcgttggcattattaaaccgtccgtcgctcttaattcttgacgagccgacaaacggattggacccgatggggattcaggatttgcgggaatttatccgctccctgcccggacagggaatgacggtgattttatcaagccacctgttatcagaagtggagcagatcgcagaccatatcggaatcatcagtgacggcgttttaggatatcagggagaaatcagccgggaagacgatctggagcggctgtttctggaggttgtcaaatcaacacgggagaaagcggggacaggaaaatgattcagtacatgcaggcggaacaccttacatctaaaagaacatttatcagaaagctgatcattctgattccgcttctgaacgcggctttttcttttctgctgaatgcggcctattttatgacgggcacgttcaattggtgggcggttattttcatgccgctcatgattgctctaatgtgcggtttatctgttaaaaaagagaaaaaatcagcgaatgaccgcgcggtgtactcattgccggcagatttaaaaagcatatggttctcaaaaataagtttgatcgcgctgtattcactcctgtcgcaaatcgtctttttagtcatcgtgtttttgcttggccttgtgtttccggcaattgctgcgctgcagctgaaaggcgttgaagcaagctcccttttgtggctgacgacgctttgggaaatcccattgtgcttatggattgccagacagttcggatttacggcagtcattctcatcaatatgatcgccgcctttgttttaggcattgtgccggcgtccggttcattgtggtggctgagtccgtggagctggtcagtccggctgatgtcaccgattctcggaatccacccgaacggaattccgcttcccgcaaacagcggcttattaaacggaaacgtgatcattccggctattattctttctattctttcttttatcgcaataagttttgtttccgcagtgtcattttcaaaaggaggaaaccggtcatgaccgtgcttttacgatatatgtgggccgatgtattaaaaatgaagcgcacgccgctcatatggatgcatgctgcggcgccggttttatgcgcgggatttttcctgttatatatgtatggaagggttcaggagtcttatatgctgtacagcgtctttttcagcgcgattgccgttttataccctctgatcatcagtattgtctgcggcatgtctgcctctgtcgaggaacaggcgggccattttcagatgatgctggcggttccgtattctaaaatcgtcagttttgcgggcaagctgcttctgctgctcctattgaatgtgttatcggttggtctcgccatctgtctttatttggcggggttgaaatttgttcttcacatcaatgatctcccgtatcttctctttttaaaaggaggggcgtggctgattgccggcagtattccgctttatatgatgtctttttttgtcggcataaagtacggcatgggaccgtccgggcttttagggggtgcgggattattaatggcggcgctcatgaatacgggacttggcgatatcatctggcgtttttttccgtgggcatggagcgtgaggctttcaggccttgcaggactgctgcattttgacaaagtcaaaaaagagttcctcccttatgtaagatacgatatgagattcggagaaataatgttatatttttctatagtgatattatgtctggccggcctctattggtgcagaagatgggaagggcggcgttcatatgaataaaggcaaggagcgattcggccggtggcaaacattttagcaattgatgatgaaaaagatattctcgttctgatcagaaacattttacagcgtgatcagcatacagtaacgattctggaaaaagcggaagatcagtcattggatttttttcaaggctatgatttgattcttcttgatgtcatgatgcccggaacggacgggattgaactctgccggcggattcggccgctggtggacagcccgatcctgtttttaacggcaaagtctgacgaagaatccattgtgaaaggcctcatgacaggcgctgatgattacatcacaaagccgttcggcgtacaggaattgatggcaagggtaaacgcgcatgtcagaagggaacggcgggaaaagcatcagacgaaacggctgatatcaggcttcatgtttgattttgacaataaagaagtatggatggatgaccggaaactgcctcttacgaaaaacgaatataaaatcgttgaatttctggcacagcataaaaacagaacattctcacgggagcagatttacgaggaagtgtacggcttggacggcgatgcgctctattcaaccattacggagtttatcagaaccatccggaaaaaatgtaaagaacacggggctgatccgatcaaaacggtgtggggtgtcggatacaaatgggaatagcaaaaggaaaatccagcatccgcaaagagcttgtcaaatttaccatcactttgtgtctgagcacgatgggggtggcggcattatgcgtcgccttaaatgccattgccatgaatgccggagcgatcctgcccgcaaactacagcgagcatgaggcggaacagatcaaaccccgcctgaaatcagcggaaaagataacagaagacatgatccccgcaggtatgacatacgccgtttttgataaaaaaacaaagcggatgacaaaaggaacgatgacggaacaagatgcggccaacgccagaaaaaagattcagcatacgccgtattttaattatgctcaaaaaggattcatggtgataaatcggaaagatgaatacggcgttctccaatattcactcaggtcggaatttcagtcgccgctgttaaggcgctatctgccgaattatgaatggacgggtcttacgattctgatcactttgcttcttttgactgtttttatcgtgacgacgcgtttcgccaatcagctgagacggcatttcagcacactcagctccattacggcaagcattcaaaaacagaatttaaatatcaatccaaaaaggtcgcgtataaaagaatttgacgatgtcattgactctctgctgaaaatgaaagacgcgcttcaggcatctctggcggcgcagtgggaggcggagcggataaagaaagaacagatcggcgcgcttgcgcatgatattaaaattccggcaacgatcattaaaggaaatgccgagctgctccagttaacagaacctgatgaggagcaggcggaatatgcgcagtatatcctggatgccggaaacaaaatcgagcattatgtcggacagctgatccagctttccaaagcagaggaggcagttgccgttcatgtcgaatataccgacctcaaagagtggattcaaaacatatatcgtgacgcggcggcgcttgcggggccgaagcagatggatctcgtcctcagcgaacggggaattgaccgaatagaagcgccgatcgatcatgagctgctccacagggcggtcatgaatatcgcggcaaatgccgtcgactatacgccggaaggaggggaaatccgtgtggacgtcctgtgcaccgattccgccctccatcttgccgtatccgacagcggaagcgggttctcgccggaggcgctgaaaagagcgacacagcttttttacacggaggataaaagcagacattcggcggggcatcacggcatggggcttacattcgcccatcacgtcgtacatcttcatcacggcgaattaatacttgaaaatcaggagtctggaggagcccgggcggagattcgaattccgctggaaggcgtcagacaaaaacaagccctgcacgcctgagggcttgtttttctgtataagaaaagcaaaaataaaaacggctgtccgtttgagagatcagccgcttatgcggaaaagagtttatcaggaaggatcaatccatgttgaagaccacttggaaatttcctctaaaataggggctaatgcgcagcctttttccgttaaagaatactcaatgcggacaggcgtttcggggataacatcccgtttgatgacaccttctgtttcaagttctttcagacgttctgacaagactcttccgcttaaattcggaagcgccgcttcaatttcgctaaatcgctgctgtccgttcaataactgaaagacgattagagccacccagcgtttacttaggatgtcgaccgctttttcgaatctggggcacatttctgattggttcatgctttttcacctcgtcttctgctattataccgcaaaatcggagggaacgtacgtctggcgcttgttaagttgaggagaggatcaaaaagaggatgaggaatccggggagcgttttttcgcttcagccgcaataaaatcaaagtatttgctgacgctttcaatatcttcttttgtgaagtgctgccactttttgctgtcaaacagcggcagatgctccgcgcctctgtcaacggcggtctgatagatggcgcagatggattgatagctttcggaggtttcacggatttcctcctgaaatgccttgatgtgtccggcccgcgccattaactcctcgtacgggatttttaatgtgtccgccaattttctgatggtcgcgggtttaggaatgccgcggtgcccgttttcaattctggaaatggtcgccgagctgacgccggaatagacggcaagctgattgacggtaagcttccgggcgcggcgcagctctcttaattgctttccgaatgtgttcaataagatcgcctcacatgtgcaaagtcatgagtcttcatttgttctttttttggcttccgccgataagaacgcaaagtatttatcaagcagaaccaagtcttctttcgacaggtgccgccagttctcccgctccaaaagggataaatcatgcagctcatacgtttcggctttttccagcaaggtgcagcccgtgtcgtacggggctctcgtttcctggacggtctctatgtatcccgccgtctgcatcagttcctcatacgggatttttaacgcatctgcgagctttttaatggttgcaggtttcggcactccgcgtttgccgttttcaatccgcgagattcccgcggcgctgacgcctgaatacgttgccagctgattcactgtcagatgccttttttcccgtaatgtccgcaattgtttcccgaagctttccacagtctctccccctcccgcggtctatttatattctagtatgtttattgactaaagggaatagccaggctggaaaagtattgacaaaagttaacaaaagccgtatcttatgtataagaaagaaagtatttgacagaacggaaggtgaagaaagtggtcgaaaagatacagatcagaagagattatgtgctgcagtatatggtcaataatgactactcgttaaaccagctcgccctggagatcggaatatctcccgccacactgagccgtgtactgaatggagagcgaaggccgggccagctggtcatcggaaaaatgctctattactttgacatgaaatttgaagatcttttttactacgactttgttgacaaaagtcaatgaagatggaagattcaaacgcatttccgtttttctgacatgatgtacaccgatacggcgtgacatgcctttgtttttcatgtaaaatagaagcaatgtaggccagtcagtctggaggtgtatgggatgcacacattattgattaccttattggttatcgtcagtattgcacttattattgtcgtattgcttcaaaccagcaaaagcgccggtttatcgggtgcaatttcaggcggggcggagcagcttttcggaaaacagaaagcaaggggccttgatctgattcttcaccgcacaaccgttgtgctggcagtcttgtttttcgtgttgacgatttcgctagcgtatatcgtataaggcaatgtttgtataaggtctgatttaatatcaggcctttttcttgttgagagacggcgtttgtttctcgcaaaactgtggaaaactaaattgaatgtgcaaaaaaggggttatgagcatgaaaattgtgacaccaaaaccatttacatttaaaggcggagacaaagcggtgcttctgctgcacggatttacgggaaatacggcagacgtcagaatgctcggccgctacttgaatgagcgcggctacacttgtcacgcgcctcaatataaagggcacggcgttccgccggaagagctggtacatacgggacctgaagattggtggaaagacgtcatggacggttatgagtatttacggtctgaaggctatgaaaacattgcggcgtgcggactgtcgcttggcggggttttttcattgaaattgggttacactgtacccataaagggaattgttcctatgtgtgcgccgatgcacattaaaagtgaagaggttatgtacgaaggagttctctcctacgcgcgcaattataaaaaattcgaaggaaaacagccggagcagattgaaaaggaaatgaaggagtttgaaaaaacgccgatgaatacgctcaaatcgctccaggagctgattgccgatgtgcgcaaaaacgtcgacatgatctattccccgacatttgtggttcaggcacggcatgaccatatgattaatacagaaagtgcgaacatcattttcaacgaggtggaaacggacgacaaacagctgaaatggtatgaagaatcaggccatgtcattacactcgataaagaacgggacctcgttcatcaggatgtgtacgaatttttagagaaactcgattggtaacaaacaggaggtcgaataatggaaaaagaagcgtttatggaccgtcttctcgcgtttatgaaggaagaggcgtacaagccccttaccattcaggaactcgaggagatgctgaacatcacggaagccgatgaatttaaagagctggtaaaagcgctggtggcgctcgaggagacgggacagatcgtccgcaccagaagcaaccgctacgggcttccggaaaaaatgaatttagtaaaaggaaaaatttccgcgcatgcgaagggcttcgcgtttctgctgccggaggatacctctttaagcgacgtgtttattccgccgaacgagctgaatacggccatgaacggcgatattgtcatggtgcggctcaattcccagtcaagcggatcgagacaggaaggcacggtcatccgcatcctggaaagaagcatcgaccgcgtcgtgggcacatacacagaaacgaaaagcttcggctttgtcatcccggatgataagaaaatcacgagtgatatttttattccgaaacatgccaataacggcgctgcggaaggccataaagtcgtcgtcaaactgacaagctatcctgaaggcagaatgaacgccgaaggggaaatcgttgaaatactcggccataaaaatgatccgggcatcgatattttatccatcatccataagcacggcctgccgggagattttccggctgaagcgatggagcaggcaacaagcacgcccgataccatcgatgaaaaagacatcaaagaccgccgtgatctccgcgatcaggtcattgtcaccattgacggcgccgatgcgaaggatctggatgacgccgtcaccgtgacaaagcttgataacggcagctacaagctcggcgttcatattgccgacgtcagccattacgttacggagaattccccgattgacaaagaagcgctggaaagagggacaagcgtgtacttggttgaccgggtcattccgatgatcccgcacagactgtctaacggaatctgttctttaaatccgaaggtcgaccggctgacgctttcctgcgaaatgacaatcaaccagcagggacaggtgacggagcacgagatcttccaaagcgtcatcaaaacgacggaaagaatgacctattcagatgtcaaccggatccttacagaagacgacgccgagctgaaagaaagatatgagccgctcgtcccgatgtttaaagacatggaacgtctggcggaaattctccgggcgaaacggatggaccgcggcgccgtggattttgatttcaaagaggcgaaggtgctcgtcgatgaggaaggcgccgtaaaagacgtcgtcatcagagagcgctcagtagcggaaaagctgatcgaagaattcatgcttgtcgcaaacgaaacggtggccgagcacttccattggatgaacgtgccgtttatttaccggattcacgaagagccgaacgccgaaaaactgcaaaagttcttggagttcgtcacgacattcggttatatcgtcaaggggaaagccggagacattcatccgcgcgcgctgcaaagcattcttgatgaagtgcgggaccgtccggaagaaacggtgatttcaacggtcatgctccgttccatgaagcaggcgaaatacgacccgcaaagcctgggccatttcgggctggcgactgaattttatacgcacttcacatcgccgatccgccgatatcctgacttaatcgttcacaggctgatcagaacgtatttgatcaacggacaatcggacgaagcaactcaggaaaagtgggccgaacgccttccggaaatcgctgaccatacgtcaacgatggaacggcgcgccgttgatgccgagcgggaaacggacgatctgaaaaaagcggaatatatgcttgataaaatcggcgaggaatttgacggcatgatcagttccgtcacgaatttcggaatgttcgtcgagctgccgaatacgattgaagggcttgtgcacgtcagctttatgacggatgattattaccgttttgacgagcagcatttcgccatgatcggtgaacgcacgggcaacgtttaccgcatcggagacgaaatcacggtcaaagtcgtcgacgtcaataaagatgagagaaacatcgactttgaaattgtcggcatgaaaggcacccgccgtccgagagaaacaacaggcgaccgcagaaaacgaggcagaccggcgcggaaacgcgtgttaaacagcaataccccggcttcaccgccgaaatcggaggaaaaaggggaatggtttacaaaaccgaagaagaaaaagaaaaaacgcggcttccaaaacgcgccgaaacaaaaacgcaaaaagaagaagtaaatgcgaaaagcaaatagggcataatgctctgtttgctttctttcgcaagccgcattttcattgtcgcggaacgctccatttgctaaaataaagcgtatcgcacacatgaacggtttttgcggagagaggaggataaggcatgccaaaaggatcaggcaaagtattatcgcaaaacaaaaaagcaaaccatgattactttatagaagaaacctatgaaacaggcatcgtgctgcagggaacggagattaagtccatccgcgccggccgcgtaaacatgaaggattcctttgcgaaaatcgagcgcggcgaagtgttcctccacaacatgcacatcagcccgtacgagcagggaaaccgctataaccacgacccgctccggacgagaaagcttttgatgcaccggaaagaaatcaataagctgatcggcctgacgaaagagaaaggctattccctcgtgccgctgaagctgtacttgaaaaacggcttcgccaaagtattaatcggcctcggaaaagggaagaaaacatacgataaacgtgaagatttaaaacgaaaagacgccaaaagagaaatcgaaagagcgttcagagacagacaaaaaggcttctgatgcctgagccttgatgtgatgatatgccctgtgctatactgttcacacatcagattcacaggctgtttattgaagatattcccaattgaatttgcctgtgatcatggtataataacagtacagccagttgagcaagagcttgatagatctcccgtatacccttaacaaggggacgttacggattcgacagggatggatcgagcttgagctgcgagccgagaggcgatctcgttaacacgcacctaaatataactggcaaaactaaaagttttaaccaaaacttagcactagctgcctaataaacgcagcgagctcttcctgacattgcctatgtgtccgtgaagagcacatccaagtaggctacgcttgcgttcccgtctgagaacgtaagaagagactgacagactagctctcggaaggcccgcccgcaggcatgaagacgagtgaaacacgaaatatgcaggctacgctcgtagacgcttaagtaatcgatgtttctggacgtgggttcgactcccaccgtctccatacataacagaggaaccgcagtgccgtcacatgacgcactgcggtttttttatgccgacaaaaaggagtgaatgtaaatggaaatcgtcatcatagacggaaaagatgttacaagcacagaagctttacaccgaatcttaaaagatcaattagatttcccggacttttatggtgaaaatctgaacgccttatgggattgtctgacaggctggatcgaacttccgctgactttggtgtggaagaattttgagatcagtcagaaggaattgggttcggatgctgatgatgtcttggagctgtttcaagaggctcaggcagaattagatggtgaatttttcattcaaattgatcagccgtcagccgggacaacggacaggcactaaaaagtgcgtacttcccctcatccatttttctatccgataatagggacggaaggtttcaggctttcgatttctgtccatatataagaagagacttgcgatagggaggaatggatgatggacttgcagttgaaagggaagacggcgcttgtgacgggatctacgtcaggcatcgggaaggcgattgcggcttcgctgattgcagaaggtgcggccgtgatcattaacggccgccgtgaagaaaaggtgaacgaaacgatccgggaactagagaaacagacgccggatgcccgtctctatccggccgcgtttgatttaggcacggcggaaggatgcggcgcgatttttcagcagtatcctgatgtggatattctcgtcaacaatttaggaatctttgaacctgcggaatactttgatattcctgacgaagagtggctccggtttttcgaggtgaatatcatgagcggcgtgcggctgacacgccggtatgcaaagcggatgattgagcggaaggaaggacgggtgatctttatcgcgagtgaagcggccgtcatgccttctcaggaaatggctcattacagcgctacgaaaacaacgcagctgtcgctgtcacgcagcctggccgagctcacggaagggacgaatgtgacggtgaatacggtcatgcccggctccacgaaaacagagggcgtcgaaacaatgcttgagtcgctttatcccggtgaaaacttgacagcggctgaagcggagagacgatttatgaaggaaaatcgtccgacgtccatcattcagcggttgatccgtccggaagagatcgcccactttgtcgcctttttaagcagcccgctgtcgtctgccattaacggatctgcattgcggatcgacggcggcttggtgcggagcattatataagatgaacataaaaaacccccgcaaagtggcgggggtttttttaatgcggatcacgctgaaaccggctgatgatcctgctgattaaatcttttgttgcacagtcaaagtgctcttctttttggtttgtcaaaagcccgacaggcggtgaaattgttaagttatggatcggaatgaccttcgtgccctcgatcggctctgaatgcgccgtcgccgtaaagattgagacgccgatattttccctgacatagtattgatgagccatgctgctggtcagctccatttttcgatagcggctcccgatggcccgctgcaggtgctgttcaatttgaatccggatcgggcaattggcgggcgtaaaaatcaggcattcattttctaaatcttcgagattaacgcttgctttggcggcaaggggatgtctgtctgacacgatgacattgagcgagtcatggaaaaacggatcgaaataattttccagaatcagctccggctcgccgcataccgcaaaatcaatagcgccctccagcagtttgcggctgcatgtattggcatcatccacgctgacattgaccgacatgtccggataatcatttaagaaaccccgcagcacggcagggaagatcaggcttgccgtcggttcggatatgccgatctgaataaggccggcctggccctgtctgatatcggccagagtatggtcaagcacctcgtattgcgcgagaagctgcccggcccgctcatgaaacagccgccccgcccttgtcagcttcagcttctttccacgttcaaacagctgcgcgcctacatcctgttccagctgtttaatccgcattgaaatcgtcggctgtgagtagttcagaatttctgcagccttataaaagctgcctgactgtacgatggtatgaaacgttttaatggttcgtagttccaacgaaatcccctcccggctgttcattaattttcttgaacctttcctttactttttttgattagtcaaacaaatcagtttgctttatagtataaacaatcaaagcttagtaaacaaattggaattatatattttttgcggggagagtgaccggaatgagtgaagacatatttcgattggctgagaaaaaggatgcgccggagtttttagagctgctgtacagcgcgtttcagccgatccgcaatttggagattgactggccgtcggcgcgggccgacatcgatatggtaacggaaaatattgaaaatcattcagccgtcgtgctcgaacgggatggacggcttctttcaaccattacgatccgttttccgtgggagagtgacacgcctccgtcaaaatatccgtttgtctggtggtttgcgacgcttcctgagctgaaggggcagggcatcggcagcaaacttttgacttatgtggaggaacatgtgctgcgggatacgctgaaggccccggccatcacgctcggcacttcggcgcgcaagcatccctggcttgtagatatgtacagacggaggggatatgaagtgtattttgagcaggagaaagacggagacatcggagttatgatgagaaaggtgctcataccggagcggtttgacgcgtcgctgttaggcacaccgagctgggcgcaatgatcaaaaaacggatcagagccggctgtctgcttctgctgctcggcgtgctggccgggtgcgggcaaggagaaagcgcaaaagcggggagcggcgtgcagaccgtcatcgtcggcacgggaactgattttccgaacattgcttttatggatgaaaaaggcgagctgaccggctatgacattgaagtgatgaaagccattgatgaacagctgccgcaatacaaatttgtctttaagacgatggatttttcgaatctgcttacaagtctcggaaaccggaaaattgacgtgatcgcgcacaatatggcgaaaaacaaggaacgggagaaacgctttttgtatcacaaaatcccgtataactactcgccgatgtacatcacggtgaaggcggataatgacgcggtacgcacgctccgggatttaaaagggaaaaccgtcatcgtcggcgcgacgtcaaacgcggcggattatatgacggcatacaacaaaacccacggcagcccgatacatttgaaatacgccgggcagggcggcaatgatacagcgaaccaaattgagacaggacgcgctgacgccaccgtatccacgccgtttgccgtcgattttcaaaataagacgcacgcgttcaaacaaaagacggtcggtgatgtgctgctcgataccgaggtgtattttatgttcaataaaaacagccaaaccctggcggacgatacggatcgggcgattcaaaggcttgtgagggacggcacattgaaaaggctgagtgaaaaatggctcggcgcggattattcaaaatcaagtttcacgaaataattgaagcagaaaacggggcgatcacatgaaaataagattggcggtcatgtcattaacaattgcggcaacggcggcgttatcagcctgcggcgcgggaggggaggcggcatcaggcaatcagaaaaacgtgaagaacattacggtcggcacggggactcaattttcgaatatttgctttattgatgataaaggcaaattgacgggctacgacgttgagctggtgaaagagcttgacaggcgcctgccggactatcgatttacctttaaaacgatggatttctccaacctgcttgtcagcctcggccagcataaagtcgatatcgtggctcatcaaatggagaaaagcgccgaacgggagaaaaaatttctgttcaatcaagtcgcgtataacaacttcccgctgaaaatcacggtgctccaagataatggggacattcacggcattaataacttgaaaggaaagcgggtcattacaagtccgacgtcaaacggcgcgcttgtcctgaaaaaatggaatgaaaaacacggcagtccttttgaaatcgcctatgccggccaaggttcaaacgatgcggccaatcagctgaaatccggccgcgccgatgcaacgatttcaacgccgtttgctgtcgattttcaaaacaaaacgagcgcgatcaaagaaaaaacggtcggcggggtgctgtcaaatgccaaagtgttctttatgtttaacaaaaatgaacaaacgctgagcgatgacattgataaagcgctcaaggaaatcattgatgacggcacgcttaaaaagctgagtgaaaagtggctcggcgcggattattcaagggagcaatattaagtgaaaaagagagggaccggcaatggaaaaagcgtttgatatcagtatgatcgcgtcctttgtgccgacattgctcgggtatttgcccgtcacgctgtatatattggcggtgtctttgctgttcggctttctattggggctgcttttggcgctgccccgcatctatcgcattcccgttttgaatcagtttgcgaagctgtatatctcttttttcagaggaacgcctatcatggtgcagctgttcattgtattttacggcattccggcgctcacggcgctcgccggaattgatacctctaaaatggaccctttgtatgcggccatcgccacgtatgcgctgagcagcgcggcaagagcggccgaaatcatcaggggaggtgtgaacagcgtcggccgcgggcaggcggaggcggcgttcagcatcgggctgaacagagggcagacattccggcgcatcattctgccgcaggcgctcgtgcaggcctttcccaacatcgggaatatggtgatcggtttcttaaaagatacatcactcgctttttcgatcggggtgatggatatgtcgggcagaggacagaccttgattacatcgagcaatcattctcttgaagtgtatatctcgctgtctgttctgtattacgcggccgcccttttatttgaatgtgtcttcagatgggccgaaaaacgaatcaagaaagatgagacgcgccttgtgacggtttttgacatgagtgcgcacggctgaaaaggagggagaacagtggagctggacattccgtttatcggcactgcgataaaacaaatgttgaaaaccgttccgcttacattggcgatgacgatcattccgattattgccggatttttcatagctctcggcaatatcacggtgcgtatattccgcatcaaatggctgctggcctgctcagcgttttacgtgtcttttttccgcagcaccccggcgattctccatattatgctgatttatttaggggttccgctgattgccgatcaattcagccgcgcgtttcatctcggctggtcagccaatcagattccggtcgccgtgtttgtcatcatggcactgtcattaacggcaggcgcttatatgacggaaattctccgatccgggatcatggccgtcgatacggggcaggcggaggcggcatattcaatcggtctgacgcggggccagttgattcggcgcgtaattctgccgcaggcgttcatgatatcgctgccgaacttcaccaatataggcatcggctttttgcataccacttccatcgcggcaattgttgcagtgcctgaaattacaggaacggcgacgattgcggcatccgataactatgcgtttctggaagcatttatcggggcggccgtgatttattggggattaacgctgattctcgaagctgtaaacagtctggcggaaaaaagagcggccagatatcaaggaggcgcattatgatcgaaatccgaaacattcagaaatattttggcagtcatcacgtgctaaaggggatcaatttaagtgtccggaaaggagaagtcgtgaccatcatcggcccgagcggttccgggaaaaccacttttctgcgctgccttaatttgcttgagcggccggatgagggcgccatttcgctgcacggtgaagtcattaactgcaaaaagcctgccaaaaaagacattctcagactgaggaaacagacagcgatggtttttcagcaatatcatttgttttcgcataaaacggcgattcaaaatgtcatggaaggcctgacggtcgcaaggaaaatgaaaaaaacagacgcgtacgccattgccgagcgggaactggccaaggtggggcttcaggataaactacacgcctatccgaatcaactgtcgggaggacaaaagcaacgggtcgggattgcccgggcgcttgccattcatcctgatgtgatgctgtttgatgaaccgaccgccgccctcgatccggagcttgtcggcgaggtgcttgaggtgatgcttaacattgtgcggaccggcgctaccatgatcattgtcacacatgagatggaattcgccagaagagtgtccgaccgaattgtgtttatggatgaaggagcaatcgtggaacaaggaacgcctgaggaagtttttcacaagacgaaaaaagaaagaacgaagaagttcctccgccgcgtgctgcctgattacggttatgacataaaagagcgcataaaggagcctgtcgtatgattcgtttaagcattttagatcaaagtgtcaccgcggaaaaccaaaccgcagaagaagccttgcggcaaacggtgaaattggctcaggaggccgaacaatacggatatgaccgtttctgggcggcggagcatcataacaatgaagagatagcgggatcagcgccggaaattgttctggggtatcttgccgcaagcacgaaaaaaatccgtctcgcatcaggcggggtgatgctgcagcattacagtccttataaagtggcggagcagttccgggttctgtccgcccttgctcccggccgtgtggcgctcggtgtcggcaaagcgcccggcggatttcagctgtcaaccgatgcgctgcagcgggagcttatccagcccgcccgtttgtttgaagaaaagcttgaggagctgactcatttcattcgaaatgattttccggactcgcaccgctacgcgtcattgcggccgacgccgcatactgagtatgcgcctgacatctttttgctcggcagcagcgcggaaagcgcgatatccgcggccaaactcggcatttccttcgttttcgcctatttcataaacggtgaagaggctgcgttagaaaaagcgcgccacgcctttgacgagcatctgccgaaaggatcgaaggcggaatttcaccttgcgccgatggtatttaccgcgcatacaaaagcagaagcggaaaaacacgtcgtatcgcgtgagtcggtcaaaatcattctcgaagacggcaaaaaggtgaatgtcggttcccgggaacaagcggaagcgtttctggaacaagtcacgcagccatataagctgatcacacaaaagacgggtgtgattgccgggacaaaagaagagaccgccgccgagctgagacgattatccgttcaatacagcattaccgattttgtgattttgtcgcctatcaaaaacgctgaggaaaaacgattgtcttaccggctgttaagcgaagcggtgcagccggccccacaattataggagggatgaacatgagtcatgaagtaaacgtagtggtctggagcaaacagggctgctcctattgcgatgaagtgaaaggatatttgcgggaaaaagccgttgcatacgaaacaattgatgtgacagaacgggacgaattgcgtgacgtgctgcagacgaagtacggcatccgtcatgtccccgtcgttgaaatcggcagcggtgacagccgtgtgtatcaggccgttactcaagtcggcattgatcatgtagaacgggcgcttgccgattacgaggggaaaaagggggagagaaaatgagccggacggatctaattcaattcggagccatgattcacggtgtcggcggcacaacggacggctggcgtcatcccgacgccgatccgacagcaagcacgaatgcggcgttttacaggcaaaaagcgcagactgctgaaagagggctgttcagctttgcttttattgcggacggcttgttcatttctgaaaagtccatcccgcatttcttaaatcggtttgagccgatcactattttatcggcgcttgccgcctctacaacccatcttggtttaatcggcacattttccacctcgttcactgagccgtttaccatcgcaagacagctgatgtctcttgaccatatcagcggcggccgggcgggctggaatctcgtcacctctccgcaggcgggagccgcgcgcaatcacagcaaagaaagtcttcccgaccacagccggcgctacgacatcgctcaagaacatgtggacgtggtgcgcggtctgtggaattcctgggaagaagatgccttcgtccgcaacaaagaaaccgggcagttttttgatcctgacaaactgcatcgcctatatcataaaggcgagtattttcaagtggagggcccgctgaatatcggccggtccaaacagggagagccggtcgttttccaagcggggtcttcagaaaccggccggtcgtttgccgcgcgtaatgccgatgcagtctttacgcactccaattcacttgaggaaacgaaagctttttatgatgatgtgaagaagcgggcggcggattacggccgcgacgcttccaagctgcggatctttccgggaatcagtccgattatagccggttcacaagaagaagcggaagcgaaatatcaggaattcgccgagctgataccgatagagaacgccattaaatatgtggccagattttttgacgattatgatttgagccgttttccgctggatgagccgtttcctgatttgggcgacgtcgggaaaaacgcgtttcaaagcacgacagaccgtatcaaaagagaggctaaagccaggaatcttacgctgcgtcaagtggcgcgcgaagccgcgtttccgcgaacgaactttatcgggacaccggaacgtgtggcatcattaattgaaacatggtttcagcgggaagcggcggacgggtttatcattcactctgacatcccgggcatgcttgaagcctttgtggatcaagtcataccgatccttcagaaaaaggggctgtaccgaaaaagctatccggcggatacattgcgggggaatctcgggttggatattccgatctgcaaaccaaatccgattttgagcagaaactaaatgtttctgctttttctgctgcttgccattcccgtcattacagccttttttaaaaaatatactgatttcgagatattattgttgcgaaaagaattttttgtaactataattattacagaactgatcagtataaaaaaacattcatatttcataataaatgtgtgtgtaatttgaaaacgaaagggctgtttacaatggcaaaagtactttatatcactgctcatcctcatgatgaaaagacatcttacagcatggcgacaggaaaagcgtttatcgattcttataaagaatcaaacccgaatgatgaggttgtacatatcgacctttacaaagagaacattcctcatatcgacgcggatgtattcagcggctggggaaaacttcaatccggcacaggatttgaagagctttctgaaaacgaaaaagcgaaagtcggccgtctgaacgagctgagcgatcaattcgcgtcagctgacaaatacgtattcgtcacaccgctttggaacttctcattcccgcctgttatgaaagcgtaccttgattctgtggctgtagccggaaaatcattcaaatatacagagcaaggcccgatcggcctgttgactgacaaaaaagcgctccacattcaggcgcgcggaggctattactctgaaggcccggcggctgacatggaaatgggccaccgttacatcggcatcatgatgaacttcttcggcgttccttcttttgacggtttaatcgttgaaggccataatgctgaaccgaataaagcacagcaaattaaagaagatgcgattgcccgcgcgaaagaagccggaaaatcattctgatcttaaaaaaaacctccccgccgtacggctgggaggttttttatattaaagggcaatcgtccgtttttgctcgctgcttttcatcgccgcttcaatgacacggatgacatcgatgccttcttttgccgtaacgggaagctgttttccgtttaagatgctgtccgccagcagtttgtagtacgtaaggtaagagccgttctcagaggggattgtttctgtatgccttttttcatccgctgcgattgtcagctctccgaagttgtcagggtcatcggcgccccagctgtcgtcaatcggcttttggccggctgaaagcgcctcttcctgtccgtcctttccgtatttgataaagcttgcattccgtccgtgaatctgatagcgcgggccgtttgccgcattcatagagccggattgaagaatgacctgaagtttgccgtaatggagcgcggccagaaaataatcgacggtttcactgttgtcccgctgtttcatcacatgtgccgtgacggattccggcattccgaaaagcaggagtgtctggtcaataatatgtgaaccgagatcatacagcgttcccgtggcgggtccgcttttttcgcgccatctttcttggacaaccggattgtacagatcgtagttgacttgatatgtatgaatgtcttgaagcgccccgtcccgaatcagcttttgtatcgttaaaaagtcattgtcccagcgccggttgtggtacacgctcagtaagacgcctttatcttcagccgttcttctcagttcctccgcttctgctgaagtcgccgtcatcggtttttccacgacggtgtgttttcccgccaggagacatttcatcgctgattcataatgcattccgctcggtgtcgtaacgatgacgagatcaatgtcaggatcaccggtaatgtcttcaatcgcgcgcacggcttcagcccccggcagatcacgtctgacctcatccgttctggaggtcatgacttttttgatctgataatcatcaaggacgtccaaaagcggcgcatgaaagactttacccgacaaaccatatcccaatatgccaacctgtatcgttttcaatgaatttccccctcttgatatgtgataacattatataccccgcgggtgtactggtaaaacttgtgtgttgaaaattttttacaccggattttcaagtctgtataatgaagataacgaagaaaaaaaccgaggtggaaaatggacaaacataccgagcatcaatcgttaaatcataaaagcgccaaggaaaaagaccagattctgaaccggctgaaacggattgaaggccaagtcaggggcattcagaatatggtggagaacgaacgatactgcgtggatattctcgtgcagatttcagccgtgcaggcggccatgcagaaagtcgcgtttcatctgctggaagatcacgcccatcactgcgtagccggcgccattgagagcggaaacggggagcaggcgattgccgagctgcttgatgttgtgaaaaaaatcgcaaaatcgtaaaataaaatgttttgaaataccctacaggggtatggtaacataaaaaagaaaaaacaagacgtggagggaatcatcatggaacaaaaaacactgcaagtggaaggcatgtcctgtcagcactgcgtaaaagcagtagagaccggagtgggagaactgaacggagtgacggcggttcaggtgaaattggaagccggacaggtggatgtgacgtttgatgagcacaaagtctccgtatcagatataaaagacgcaattgaagatcaagggtatgacgtcgtataaggtttatcgcgctgcgggaacgggcgcggttttcttttatcataattataccctcgtggggtttatgaagagagatgaggacattgagtgaaccgaaagaaatgaccattcaagtggggggcatgacatgcgccgcctgcgcttcaagaattgaaaaagggctgaaacggatggacggcgtcaatgacgcttccgtcaatcttgcgcttgagatctcaaatatttcctatcagcctgacaaaatcgaagctggcgccataaaggataaaattgaaaaactcggctatcacgtcgtgacggaaaaagccgattttcagattgaaggcatgacgtgcgccgcttgcgccaaccggattgaaaagcgcctgaacaaaacagagggcgttgtgagcgcaccggtgaatttcgccctggaaacagtcaccgttgaatacaatccgaaagaggtgacgccgaaagagctgaaagagaccgtggcaaaactcggctaccgattagacgggaagaaagcggttgatggagacggcggattatcccaaaaggagaaagagcagcgaaagcagctgatcaggctcatattttctgccgttctctcctttccgcttttatggtcgatggtcagccatttttcttttacttcttttatctggatgccggatatcctgatgaatccgtggctgcaatttgcgcttgccaccccggtgcagctcgtcatcggctggcctttttatacgggagcgtacaaggcgctgagaaacaaaagcgccaatatggatgttctcgttgcgctcggaacgacggccgcttacgcatacagcctgtacatgacgattgcgtctctcgggcgagacggacatgctgaggggctttattatgaaacgagcgccattttgctgactttgatattgcttggaaagcttttagagatgaaagcaaaaggccgctcatcagaagcgattaaaaagctaatgaagcttcaggcgaagacggcggcggttgagcgggacggcaaagtacaggtgattccgattgacgaggtccggacgggggatatcgtatacgtgaaacctggagaacgcgttcctgtcgatggcgaagtgattgaaggccattccgcgattgatgaatcgatgattacgggagagagcatgcctgtcgataagtctcccggaagcaccgtcacaggggcgacgatcaatgcaaacggctttctcaaaatcagagcggtgaatgtcgggaaagataccgcgcttgcacacattattaaaattgtggaagaagcccaaggatcaaaagcccccattcagcggctcgcggatcacatttccggcattttcgtcccgattgtgctggggctggccgtgctgacttttctcatttggtatgtatgggcggcgccgggacagttttctgaagcgatcggcaaattcatcgccgtgcttgtcattgcctgtccgtgcgcactggggctcgccactccgacgagcattatggcgggctccggccgtgcagctgaattcggcattctctttaaaggcggtgagcatttagaaaagacccagcgtctgacgacaatcgtactggataaaacaggaacggtgacaaacggcagaccggttctgacagatgccgtaccggcagagggaatgaacgaagaggaactcctgcggctggcggcggccgccgaaacgggatcagagcacccgctcggagaagccatcgtgtcaggagccgaaaaacgggggatttccatcccgaaactcacccggtttcaagcccggatcggttccggaatctatgcagaggctgacggcagaacgattctagccggatcaagacggctgatggaatcagagcatattgaacatgaagcgctgcttccgcaaatggcccgcttggaggcggaaggaaaaacggtgatgcttattgcggcagacggcaaagcggcggggcttatcgcagtcgctgataccattaaagaaacatctccggccgcggtgaaacgtctgaatgatatggggcttgacgtcatcatgatgaccggtgacaacaaaaagaccgcggaagccattgcaaaagccgcgggcatcggcagcgtgatcgccgaagtgcttcccgaacaaaaggcggcggaaatttcccggctgcaaaaagaaggccggcgcgtggcgatggtcggtgacggcatcaatgatgctccggcgctggctgtggccgatatcggaatggccatcggcaccggcaccgatatcgcaatggaagcggcggacattacgctgatccgcggagacctgaacggcattgccgacgccatcggcatgagccggctgactatgagaaacatcaagcagaatttaggatgggcattgggctacaacagcatcggcattccgattgcggcagccggctttctggctccgtgggtggcaggcgccgccatggcgttcagctcggtatcggtcgtgcttaatgctttgcgtttacagaaggtgaaaaaagacaaaatcggctgatgccggttttgtcttttttattgacactttattcaaagcctgcatataatagagaaaacacttatatgagtatatgctcatatatataaattcgtttacctgtattgatgttatgggaatcctattacggaaagtagggtgagtcgaaaatgaaagcagccaaaggtgaatttgtattagacggacttgattgcagcaactgtgcaaaaaaaatagaaaacggcgtaaaagccattgacggcatagacggctgtgctgtcaattttgcggcaagcaccatcacggtctcagccggcgggaaaaacgagcaatggatgaaagatgaagtcgcgaaaaaagtaaagtccattgatcctcatgtgaccgttcgttcgaagcacgaagacaaacccggtgaggatgaataccgcaaaaagctgcagctgatgttagtgagattggcggcgggcgccgttttggccgtcatcgcttacttcgcgcacacgggcgccgtccttgagtttctgctcttttttgcttcatatttgatcatcggcggcgatatcgtagccagagcgggaaaaaatattgtccgcggccaggtatttgatgagcattttctgatggcgcttgccacaatcggcgcatttatcattcatcaatatccggaaggcgtcgcggtcatgctgttctaccagatcggtgaattgtttcagggagcggccgtcagccgatccagaaaatcgatcagcgcgttattggacatccgtcctgagtacgccaatgtgaaaacggaaaacggcatggctgccgttcccccgcaggacgtcaaagtgggacaggtcatcatcgtgaatcccggagaacggattccgctggacggaaaggtgctgagcggttcctcgatggttgatacatccgctttaacgggcgaatccgtgccgagaaaagcggagccggggcaagaggtgatggccggatttatgaatcagaacggcgtgcttcatattgaaacctctaaagggtatgaagactctgccgtgtcaaaaatattgaatctggtcgaaaatgcggccggacgcaaagcgaaaacggaaaactttattacgaagtttgccaagtactatacaccggccgttgtcattgttgcggtgcttctcgcctttttaccgccgcttctcgtgccttcagccgcgctatccgactgggtgtaccgcgcgctgattttccttgtgatttcttgtccgtgcgcactcgtcgtctccattccgctcgggtttttcggcggtatcggggctgcgtctaaagcaggggtgctcgtgaaaggcagcaactatttagaagcgctcaatcaggtggcatacgccgtgtttgataaaacgggaaccttaacgaaaggcaatttcgccgttactgatatcaaaccggcggcaggatttacgaatgacagcctgcttcatgcagccgcgcttgcagaagtccattccaatcatccgattgcttcttccatccgcgaagcttacaatcaaccgctcgcggctgaggagattgaagaatatgaagaaatacccggacacggcattcgggtgaaaaccggcggatcaacgattttggccggaaatcaaaaactgctggcaaaagaacaaatcgcttccggcacagctgaaaataacggaaccgtcgtttatgtcgccgtggatcagcagtatgcgggggcaatcgtgatcgccgatgaaatcaaagaggacgccaaacaggccattgccaatttaaaagcgctcggcgtgaagcggacagtgatgctgacgggtgattcaaagcagaccggagaagctgtcggcctcgagctcggtattgatgacgtgtacacagagcttttgccgggtgacaaggtagaccgcgtcgaagaacttgaagcggcgctttcaccgaatgaaaaactgatgtttgtcggcgatgggattaatgatacgcctgtgcttgccagagctgacatcggagctgccatgggggctctcggttctgatgccgccgtcgaagcggccgatgtcgtcctgatgacagaccagccgtcaaaagcagccgaagccatccggattgcacgccgcacacgccggatcgtctggcagaacatcggatttgctttaggcgtaaaaatcatttttctcttgcttggcgcattcggattcgccaccatgtgggaagcggtcttttcagatgtaggcgtcacgctgatcgccgttgccaacgcgatgcgcgtcatgagagtgaaagcggaataattgtcaaagataattcgtttttcagggttttcttaaacaaggttgtcttggtaaaatagagaagcgggccatccggcatccgcttcttttttattttaaaaacaatgaggtgtctgagtgaaaaagaaacaatcgtctgcgaaatttgcggtgattctgacgttaatcgttgtcgttttatttgcggccatcgtaattattaacaaccaaacggaaaaagcgggcgaaacagtcgccgaacagccttccattaaaggacagcccgtgctcggcaaagacagcgcgcctgttacggtagttgaattcggagattacaaatgtccgtcatgcaaagtatttaacagcgatatctttccgaaaatcaaaaaagattttatcgataaaggcgacgtgaaattttcatttgtgaacgtcatgtaccacggaagcggctcgcgtctggcggctcttgcttcagaagaggtgtggaaggaagacccggcatcattctggactttccatgagaagctgtttgaagagcagccgtcaagcgaacaggaatgggtcacgcctgcattgcttgaaaaaacggtcaaaagcaccgcgaaaaaggttgatcctgacaagctgaaggaaaaccttgataaagaaaccttcgcaaaagagctgaaagctgacactgacctgaatgataaattaaacattacggcgacaccgacgatttatgtaaatgacaaggtgattaatgacttctctaaatatgatgagatttcaaaaacgattaagaaagagctgaaaaatgaaaaatagaatcgtgtttttatatgcttcttgggtgatagctcttgctgccatgctcgtcagcctttatttcagcgagatcagaaaattcataccgtgcgagctgtgctggtatcaaagaattctcatgtacccgcttgtcctgattttaggaatcgccaccttccagggtgacacgcgcgtgaaaaaatatgtgctgccgatggccgtcatcggcgcatttatatcgaccatgcattaccttgagcagaaggtgcccggtttcagcggcatcaagccgtgtgtctacggcgtgccttgctcatctgaatatattaactggttcggtttcattaccattcctttcttggcattgacggcatttattctcattattatctgcatgtgttttgtcaaaacggaacgcacggcaaaataaagagcctgctccatgggagcggctctttttctattatttgtaccaagctttgtttgtcgcaatctgtctgttatgggagctgtcccaaatatccacggaataggcataatcataattcatgacgcagcggatgccgctgccttgggcgtcatgctgaagtccgaagttatgggaaaactcgtgctgtgccgctttcgccgtgttggccgttccttgatcaaggttcacgctgaaagccgggccgctcggtttgccgttatatacatacgcgataccgccggcgtcaaaactcgattttgcggtaaaaccgacgacaaaatgataattttgatttctgaagctgctttggagattcgataaaatctgagaactgtttgagccggaagaattccaagcctgcacggcctgtacgacgaaatcaatgttgtgatcacggttaaaagcgacatccgcctgctccacgatctggacgattcgcgtttgccagtcgctgtatttggcgcggtattcagcgtccgccaccgccagcactctgaccttctgggagcccgtgctggctttagttgaggctttatcctgactgacattggcattgaatcgtttcgtgccggcctgcttgccgttctcatccagaatttttgtgtcaaccgtctgttcaacttggaccgggcctttcagatctttaaaatgatcggctttcggaagcgggtccgtatacaccgttttcgccggctccgcatgagtgtgcgaatgcgtatggctttcggctgacggcaggccgggaattaatccggcggccaataaaacaggaaaaacaagtgaactgattttcatctcataaccccctttttgttagagaaagtattcaatgaaacttccaataaaccttccattaaagtataaaataggaaaatattcttgctttcagccgttgcggatgaggttgtcccggatcaggaatcagaatctttcaaaaataaggttgattttaagagaaagcgattataaaatctaatggtcgtcagaaaatttaacaaataaaaaggagcatatggaatggcctgggagctgcttagtgtaatcggcatcattgcgtttgcggtcagcggagcgattgttgcgatggaagaggagtatgatattttaggcgtgtatatcttggggattgtaacggcgttcggcggcggagccatccgaaacctgctgatcggtgttccggtctccgccttgtgggagcaaggcgcgttttttcaaatcgctctcgcatcagttacgattgtctttttgtttccgaagctgctgttaaggcattggagtaaatggggcaacctatccgatgccatcgggctttcggcgtttgccatccaaggcgctttatatgccgtgaaaatgggccatccgctcagtgcggtgattgcggcagcggtcctgaccggcagcgggggcggcatcatacgggatttgctcgcgggcagaaagccgcttgtgctcaaggcggaaatttatgcagtctgggccgcgctcggagggttaatcgtgggcctcggctgggccggggatgccgccggtttgtatgtgctgtttcttgtgcttgtggcatgccgcatctgcagttatgtgttcaggtggcgcctgccgattcgttcctatcatatagaacagtaaaaaaaccgatttcacaaacgaaatcggtttttttgcataacggcttctgataaaaaaagacgcccgatatgataagaaaaagggtatttgaccataatgctgaataatatgttgcatatatgtttgtatgatgaaagccggacttgtcagcttgatgtcggaggtgccgctgatggcaaaacgtgataaagagtggaaagaagagcaggaaagaatcaattttgtcatgaaggaactggaacagaaacaaactcatcttgaagcctcatcgggcggattgaagcaggatattgtcggcctgagaaaaacgttttgggatgatgtcaccgtgaatatggatgatgcccacgaagcggctgagacatttttaagcattaaacagcaggcggaaatgctttcagaacgtgaacggacgcatcggcttcaataccggcagcttcaaaaaatccaaaagctgaaaacctctccttacttcggccgtgtcgattttacggaaaaaggggagtcctcttccgagcggatttatatcgggctgacttctttaatggatgaaaacaacgagcaatttctcatttatgattggcgcgcgcccatctcatctctttactatcaatattccccgggaaaagcccgctatgaagttccggaagaaacgatagagggagacatcacactgaagcggcagtttatcattaaaaacgggacgcttaaagcgatgtttaacacggatatgacgattggtgacgaaatgctgcaagaggtgctgagcggccattccggacagcatatgaaaaacatcgtgtcaaccatccaaaaagaacagaacgaaatcatccgggatgaaaaaagcaaatatctcatcgttcagggagccgccggaagcgggaaaacatccgcggcgcttcagcgggccgcttacttgctgtaccgcgggcgcggggtgcttgatgcccgtcagattgtattgttttccccgaacattttgttcaacagttatgtgtccgccgtattgccggaattgggagaagagaatatggagcaggccacctttcaggaatatatcatccgccggctcggacgaaagtttgattgtgaaagcccgtacgagcagcttgaatattgcctgactgaacaaaataaggacgcactttccgtaaggctcgcagccattgcttacaaagcgtcatcagcttttcaggccatgattgaccgctatgccgggtcgctttcggtctcgggcctgaaatgtaaacagatcagcttccggggagacatcctgatttcaaaagagcggattgaagcctatttttattcgcttgatcagcagctgccgattccgaacagagcggagctgacggcggaatggcttctcgcggaaatcagcgctctcgaaaaaaaggagcgtaagaaggaatgggtcttgcaggagagcgagctgcttgataaggaagactatgctgaggtttatcaaacactcaagaagcaggcggcagatgatgaacctgcatttgacgaccatcagcgcgaacagcgcctgcttggcgccattattgtcggcaaagcctttaaaccgattaagcaggccgtcagacggctcggctttctcgatataaaacggatgtatctccggctgttttcagactggggagctgatgaaaagcccgatcattgggagagcatcggcgctttgaccggaaacgcatttgcagaacggtcgcttccgtatgaagatgccgctccgtatctgtatttgcaggatctgttagaaggaaaaagaaaaaacacacaaatgaagcacgtcttcattgatgaagcgcaggattattccccatttcagctcacgtatattcaaaccatcttcccggcggcaaagatgacggtgctcggtgatgtcagccagtcgatttatgcccataccattacgggcccttcttccctcgccggctgctttcgcaatggtgcagaaaagtatgtcagcctgaagcggacttacagatcgacgcggcagattgttgaatttacgaaagcgctgctggctgacggcgatgacattgagccttttaaccggaacggggaaaaaccgcgtgttttgcggacggatacagaaaatgcgcggcgggaacaattggcggatacaatccgggagctcagacaaaaaggctgggagacggtcgccgtcatctgcaaaacggccgcggaagccaaaaaagtgtttcaggcggtcagcgccgagagcggtgtccgtttaatcaataaagaaaaccagccttttcaaaaaggggtatgcgtcattcccgtttatttggcaaaaggcattgagtttgacgccgtcatcgccgctgacgcctctgctgcccagtacaatagcgaacatgaccgtaagctgttatatacggcctgtacgcgggcgatgcatcatttgaccgtattgtctccgggagaaccctctccttttataaaagaagtgcccgccggcttattcgtataagccctttgctgagtgcaaagggctttttatcattagtaatcttaatcgttgtcatcatgattatatattttacttacatacaaactttcggtaaagtttcaattagaatattattttgacaattcctatagaaataacgtacgttacgtttaattccttgtgaggtggatatcgttgcaacttcaggtcatgaacagtccgtttaatcaggagcaggcagagctccttaaccgccttctgccgaccttgacagaatcacagaaaatctggctgagcggctatttggctgcggcccggtccgaatccggtgaaacagccgcgcccgctgctcaggctcctgctgaaagcccggcagtctcgaaagaagtgaccgtattatacggatcgcaaacgggaaatgcggaaggtcttgcgaaacagacggtaaagacgcttgaggaacggggattccaggtcaccgtcgcgtcgatgaacgattttaagccgaataatctgaaaaaagtaaacaatttactgatcgtggtgagcacacacggagaaggcgatccgccggataacgcgctggcctttcatgactttcttcacggcagacgcgcgccgaagcttgaagagctccgttactccgttttggcgctcggggacagctcgtatgaatttttctgccagaccggcaaagagtttgacgagcgtcttcaagagctcggcggcacccagcttgcgccgcgggttgattgcgatcttgattatgatgagccgttttcggaatggcttgaagcggtcatcggcggtttgaacgaaggagcgggaaatcaaacagccgaagcgcctgccgagacgcccgctctcggtgaatccgtttattccagaacgaacccgtttcgggcggaggttcttgagaacatcaatctgaacggacgcggttcaaataaagaaacacgtcatctcgagctttcgcttgaagggtcgggcctcgcgtatcagcccggagacagcctcggcatctatccggaaaatgatccggcgctcgttgatgagctgatcaatgagctgaaatggaatccggaacaggaagtggcggtgaataaacaaggagagcgccgtccgctgaaagacgcgcttacttctcattttgaaattaccgtcttaacaaagccgcttttgcaaaaggccgcacagtttatggctgatcaaaagctgagtgaacttctggccgaaggaaacgaagagcagctgaaagcatacaccaacggccgtgatctgcttgatctcgtccgggatttcggtccgtgggaagcttccgcggaagactttctttcgatcctgcgtaaaatgccggcccggctctattcgatcgcaagcagtttagaagcgaatccggaagaggtgcatctgacaatcggagcggtcagatatgacgcgcacggcagagaacgcaaaggcgtctgcagcattctttgtgcggaaagactccagccgggagatacgcttccgatttacattcagcacaaccaaaacttcaagctgccggaaaatccggatacaccgatcattatggtcgggccggggacaggcatcgcaccgttccgttcctttatgcaggagcgtgaagaaaccggagctgaagggaaaacatggctgtttttcggggatcagcactttgtcactgattttctgtaccagacggaatggcaaaaatggctgcaaaacggtgttcttacaaaaatggacgtcgctttttcccgggattcggaggaaaaagtatatgtgcagcaccgcatgaaagaacaaagcaaagagctgtatgaatggctgcagcagggagccgccgtatacatctgcggtgatgaacagcatatggcgcatgacgtgcaccaggcgcttctcgatatcattcaggaagaaggcggcatgagccgtgaaaaagcggaaagcttcctggcagacatgcagcagaaaaaacgctatcagcgtgacgtatattgattttggtttgaaaggagcttattcagcatggtgaacaacattttaaaagcgccggaaggccctccaagtgatgttgaggaaattaaagaaaaaagcgattatttgcgcggcacattgaaagaagtcatgctcgaccggatttcagccggcatcccggacgatgacaaccggctgatgaagcatcacggaagctacttgcaggatgaccgcgatctccgtaatgaacgtcaaaaacaaaagcttgaaccggcttatcagttcatgctgcgtgtccggatgccaggcggcgtgtcaactccggaacaatggcttgtcatggatgaactggcgcaaaaatacggaaacaatacattgaagctgacaacgcgtgaaacgttccaaatgcacggaattttaaaatggaacatgaaaaaaacgattcagaaaatcaatgcggcgctgctcgataccattgcggcctgcggagatgtcaaccgaaacgtcatgtgcgcttcaaatccgcaccagtctgaaattcatgcggaagtatacgaatggtcgaagaaattgagcgatgaccttcttccgcgcacgagagcctatcatgaaatctggcttgatgaggaacgtgtggcgggaactcctgacacggaaacggaaccgatgtacgggccgctgtatttgccgaggaaattcaaaatcggaatcgccgtgcctccgtccaatgatatcgatgtcttttctcaagatctcggcttcattgccatcgtggaggaaggccgtcttatcgggttcaacgtggcaatcggcggcggtatgggaatgacgcacggcgatacggccacttatccgcagctttcaaaagtcatcggcttctgcaaaccggagcagctgtatgatgtagcggaaaaaaccattacgattcagcgcgattacggaaaccgttccgtcagaaagaatgccagattcaagtacaccgttgaccgtctcgggctggaaaacgtaaaagccgagctggaaaaccgcctcggctggcagctggatgaagcgaaaccttatcattttgaccataacggcgaccgttacggatgggtgaagggcgtaaaagggaaatggcactttacgatgttcatcgaaggcggccgcgtcacggactatgagaattataagctgatgacgggattgcgtgaaatcgccaaagtccatacgggagatttccgtctcacctctaatcaaaacctgattatcggcaatgtctcgagccagaaaaagaaacaaatcagcgcattaatcgaacaatacggtctgacagacggctggcagcattccgccctccgccgcagttcaatggcttgcgtcgcgcttccgacatgcgggctcgccatggccgaagccgagcggtatctgccgaagctgattgataagattgaagacattgttgacgaaaacgggctccgggatgaagaaatcaccatccgtatgaccgggtgcccgaatggctgcgcccgccatgcactcggcgaaatcggatttatcggaaaggcgcccggaaaatataatatgtatttaggagcggcgtttgacggcagccgtttgagcaaaatgtaccgggaaaatatcggtgaagaggaaattctgaatgagcttcgcaccattctcccgcgctacgcgaaagagcgtgaggaaggcgaacacttcggcgatttcgtcatccgcgccggcatcattaaagcgacgacagacggcacgaattttcacgaataagatgagctcttaaaaccaaggatagagacacactggcggtgcgttctctatcctttactaagcagcataaacgctgctccgcgtcatgaaacagatgacgcagcttgcgaaaaagcctgttttcagagaaaacaggctttttctttttccggaaaaaatgtagctgaaggcaaaaaaagttcgccgtgagcgcgttatgagaaattttaaataaaaacgggtaaaataaaaggagaatggttgcgtgcggaaaatatattgaatctgcccgatcatcggctccggcctttgacaagggcagagaacaggcaataatgatatgatgcagcagatgaaggaggtcagctttggacatatttttagtcgtactcgtacttttaaccattatcgcgatctcaaatatcgtaaatcggtttgtcccctttatcccggtgcctctgattcaggtggcgctcggtatcattgcggcgtcatttccgcaggggcttcattttgaactgaatactgaattgttttttgttttgtttatcgcgccgctgctttttaacgatggaaaacggacgccgcgtgcggaactttggaatttaagagcgccgattctgctgcttgcgctcgggcttgtgtttgccacggtgattgtcggcggttacacgattcattggatgattccgagcattccgctggccgccgcgttcgggctggcggcgattctgtcaccgactgatgttgtcgcggtcagcgcgctgtcagggcgtgtgaagatgccaaaaggcattctgcgtctccttgaaggagaagggctgatgaatgacgcatccggcctggtcgcttttaaatttgcgattgcggctgccgtgacgggcgcattttcgctggcgcaagccgcgttcagtttcgttctgatttcagccggcggtttactcagcggtgtcgtcatttcttttttgattatccgtttccggctgtttatgcggcgcctcggcatgcaggatgtcacgatgcatatgctgattcaaattctgacgccgttcgtcatctatctcgcggctgaagaaatcggcgtttccggcattttagcggttgtggccggcggcatcacgcatgcggtggagcaggaccgtcttgaatcaacgatggtcaaactgcaaatcgtctcttcaagtacgtggaatattattttgttcattctgaacggtcttgttttcgttattttaggtgcgcaaataccggatgtggtttccgtcatctttaatgataccgcgtttaacaatatgatggtcatcgggtacattatcgtcattacgctgacgttaatgattctcaggtttttgtgggtgctgtttttttggaacggcaagtggttttttaacaaggatcagagcatttataaacccggcctgcgctcgaccctgctgatttcggtttcaggcgtcaggggagcggtcacgcttgcgggttccttttccattccttacgtgctctctgacggctcaccgtttcctgaacggaatttgattctctttttagccgcgggcgttattttgtgcacattggtgctggcgacaatcgttctgccgattttgacagataagccggaagacaatgtgaaagaaaagaaagtcaaattgctgacagcgagacggaagctgataaaggctgccttaaccgccattaaagaaaatatgaatgagtcaaacaaaacggcttcttttgcggtcattgccgaatacaatgagaaaatgaaaaatctcaggtttcagcagttcaccgtcaaaaaccgcacgaaaaaagatgagcggaaagtccgcgcccaagggattcaggcagaacaggaagaattgctgcggctgattgagcggggcgacataccggaagaaacggctgacagccttcaggaacggtttgatgaactggaagtgctttatacgaacccgtttaaagtcggcttatctaagaaaaagctgaaacgcctgatgtactggatctttttcggcgaacataaaaaaccggaaatgtcgattttaaatgaagaaggcctcattcgctccacaagggttaaaacggcaaaagcggccattgaaagcctgaaaaaacacatgactgaagaaaataaagatgtgacgcttgccgtcatttccttttacaatcacttgattttcaggctggggcactcgtatcacgaacagagtccgagtcgccgttttgaaaatcaaaaactcgaaatcaaactgcgggccgtgcaggccatccgcaacgaaatccaaacattattcgaagagcgggaaatttcccgcgacatgtcgcatgagcttcgccaatacatcaatgatgtggaagcggccatgcttgacggagatgaataaaaaaagtccggcatctgttcgccggacttttttagattacggacgatggaattcgacgtgatcgccgtcgcggtcaaaccagcctctgaaggcccagttgatccagccgccatctcctttgttggtgaagcttccgtcttcaaacacccaaatgccgtacgtgatgccgtcataaacggcggaaccgtaaaactgaacgccgttaaaatgatcttcatattcctggcttaaattaaacaccatgacattatatttttgtccggaagcgtagaatgaagattccattaagtttttgacgaagccgtcacggttttgcgccgacttaatcgcgtcagcaatcgaattgccgatgccgagcaggtcaacgtcaatgtttaatccgacatcttttgctgagacatctgatgtttgctgagccatgttttgaggggccgggttttcttttgcggatacaaaggacagaggagtcagagacaaagcggcgccaagggcaacggacatcgggatacgcatacgtttcatatgatttcctccttcaattgtgtggtggctacagtagcgatttacccggacagttacctgattaaccgtaatttttgaaaaataggaaaataataacgtcagtggtgcttgggcactaaagatggtttttgtgataacgatgagcgtataattggtttcttacggcggaaatgtgagataataataaccgtttacataatgactagaaaggatggttcaacgtggcaaaaagcttaaaagatactgtaaagcttcataatggcgttgaaatgccgtggttcggccttggcgtcttcaaggtggaaaacggaagcgtagcggcggactccgtcgaagcggcaatcagaaacggctaccgcagcattgatacggcggctatttataaaaatgaagagggtgtcggcgaaggcatcagagctgcgggcgttgccagagaagagctgttcatcacgtcaaaagtgtggaatgaagatcaaggatacgaaacgacacttgacgcgtttgagaaaagccttgagcgcctcggcctcgattacctcgacctttacctgattcactggccgggcaaggataaatataaagacacatggcgcgctcttgaaaagctgtacaaggacggcaaaatccgcgccatcggcgtcagcaacttccaagtgcatcatttagaagaactgctgaaagatgctgaaatcaagccgatggtcaaccagattgaattccacccgcgcctgactcaaaaagaagtaagagatttctgcaaagcgcagggcattcaagtggaagcgtggtctccattgatgcagggacagctcctcgataacgaagtgctgtcacaaattgcggaaaaacataacaaatcggttgctcaagtgattttgcgctgggatcttcagaacgaagtcgttaccattccgaaatcgattaaagagcaccgcatcatagaaaatgccgatatttttgatttcgaactgtcacaggaagaaatggaaaagatcagcgcattgaacaaagacgagcgtgtcggcccgaatccggacgagcttctgttctaagaaaaaacagccctttacggggctgtttttctttacataaatgtctgtgtctgacgttttacgctgaacctgtatgcggctattaataacagggcggcggcgaaggctcccaaaatgatgatgttcagcgtcaggctttggagcgtgcggccgtgctgcaattgatcgaccgtatcaagcacccagcgctgaggcagaaattcggcgattgtctgcactgttttcggcataatattgcccggaaaaaagcagccggcgagcaagcatgtcggtacaacgatcaagttcaaaagcgccgatgccgaagagctgctgttggaaaaaccgacggcaataaaggcgatcccgattgcgcttaatgcaaacagcatcatcaggacgaacagctgccacagcgggaatgacggatgaatatgaaaagcggcgcccataaagagaacggcgaatataatttggacggccatgataatgatattcactgccgcattcgccaatacatactgctttgacgtgatcggcgttgacagaagcctgtagtacgtcctgttttctctctctttaatcatcagttccgtcaggttgccggcggaatagagcataatgataatgagatacccgatgactgagtaagtcatttctttatggttcgaagtatctttcaaaacagcggactccgtttgaatcggagaatgcttgaaatcggcgtacatcgcctgaaaggctttctcgtctccgccggaagatttgccgattgaggcggcgctgttcatataattgtacaaataagagctgacatatccggtgacctgggcgcccttcagcgaggtcatgccgatgtgagacggtttcccgtcttttacgctttgggagaagcctttttcaaacgtaatgagcgcctccatttttcctgaagcgatctttgatgaggcggacgcatccgtttcctccgaaatcttcacatgatccagtccttttaaaaacgtgaccgtatcctgtgccacttctccgccgtcctgatcgagaatgccgatattgagcgtttcggctccgccgttggcattggtcatgaaggagaggaagacgccgatcagcggagccccgatataaagaatgagctgttttttgctttttgtaattcctttgagagtgtgtgcaaacagccaccagaagtttttcatattacagtccctcccgtctttgaaacgtaaatgcggcgatcagcaaaaagagtgccgccaatgctgtatttaaaccgagtgcaggccatgccgctgatacatcatttgcgtaaatgatgttgttaatcgccttattgatccaggataagggcgacagggcggaaatcccccctccttcatatttgtaataggcgccgccgataatggacatcacctgcacgatgatgacggtgattaatctggcgctttcgggttttctggtcaaatagctcaggctgagcccgaagctgacggccaaaagaatttcagaaacgagaatcaacagcacaagtcccatgtggctgccccagttcgctttcaagataaatttgctgaaggcgacaacggcaagaatcgtcagaacattcacagccaaaatgccgagcatctttccaagaaagatatcgcttttccggagcggggcggcgatcaggcgatccgcggtgtgccgtattctttccccgcggaataaggagcttgcaaaaatcgaggcgtacagcccgatcatcgtcgtcatggatatcgcgtaaaaatctttcgccttcggttcttttgctttgtgtaaagacgtctgcttcatataatcgcttttgatttgtccggcggaaggtggcttatgcgccttgtaagcggcggcgcctgctttgtattgattggtaaaagcggtcagcatgccttggacgatcgtgccgttgatgccgctccggtcatttgtatagacttgaaaaccggtgttttttacagtgacgaaagcatccgcctgattttcacgaacctcgtttttgccttttgcctccgtgtccgctttttgaaaatagacatgctcttttttggcgtttttcataaactcagtaaagtaatgagaaagtgtcccgtttgattggtccgtatatacgaccttgatgttcccgaccgtcacctctgaatcaaaggcgtttgataatgccgcggtaaaaatcagcatgaagacgatcggaaaagcaagcatgaaaataaaagtccgtctgtcgcggaaactgattttgatttctttcccggcgatgtgcagaatattcatttgcaatcctcctttcaatagggtcagtcgcgcagacttctgcctgtcagcgtgagaaataccgtttctaagtcaggtgcctgttcctgcaaggagcggatttcaatgcctttgtccatgaagtaccggatcaggcggtttaaattgttgacccctgtgtcagagctgattttcacgctgttttcttccagtgcggcggctctgacgccgggcagctcctgaatatcgccgaggctgatgccgtttccggatgacagctcaatcacgacgtccttcgtgtcggtaatgatggaggtcagctgttcttttgtgccttcggcgatgacttttccgtggtcgatgatggcgatgcgtgtgcatatttcttccacttcctccatgtagtggctcgtgtaaatgatcgtgcagcccatttcattgagctttttcactgattgcagaatataatttcttgattgcggatcaatgccgaccgtcggttcatccatgatgatcagtttcggccggtgggcaagggcgcaggcgatattaagccggcgtttcattcccccggaaaaatgcttcggcaaatatttgtgtttatcgctcaagccgacgaatgtcagggcttcctcgacccgttctttcagagccgcccctctcaggccgtacagacctgcgaagaacttcacattttcataggcgtttaattcctcgtaaatcgcgaggtcctgagggacgatgccgatattcattttcgttgctttgctatatttgaaaatatcttttccgagaaacagaatgtctccgcctgaaggttttaaaagacctgagatcatattgatcgtcgtgctttttccggctccgtttgcgccgagaaacccgaaaatctcaccttcttttacggcaagcgacatctggtcaacggcggcataatcaccgaatttcttactcagctgtttgagctccaaaatgttcatgtttccacctctatgtcttatgatgctcttattataaaaaaaagaatgaacggccgttagtgcagctgttcattcctttgacatgagaatcttcatatttttcacatgaaaacattcacttattcaaccggaagcaatgtcgtgacggaaaaaccggccgtgccgtcaaaaataacggttccgtgcaggacggccgcccgttcttccataccgagcatgccgaggccttttttaaagcggacggcgccgtttccgttatctttcacttccgctttcacggctttattcagcacatggatatcaatgaaaatctgcgtggcatcggcgtatttcatcgcattggttaaagcttcggttacgttttcctgaatgactctccaatgcatttgcgtcagcctgtccaaatcgccttgatgcgtaaacggaaccggcatcccgtttttggccgaaaattcatcaataaacgttcttaatctgtgaatgcccatttgttcagcgggcggtttcatatttttcagcgttatgcggatatcctctatgccctctttggaaatggtaatggcgttttggagcagttcagccgctttgtccggatgggagccgagcatccgcttcgccgcttccatctgaatgagcgcgccggtcatcgaatggccgattttgtcatggatggcttgggacaatctgtttctttcctcgagtttgccggtgtactccgattgtttgatatattctgtgctgctgtgcagctgtttcgtcagtttttcaatgcttgagcgcatgctgtccgactgttcttcatatttcttcagccgattgccggaccgggcggccaaaacgaaaatcgccagacagaacaaggttatgacgatataagtcggaaggtcgccgtacgggataaataaaaacggcaaaaacacgagcaggcagaacacatagcggtgaaccggatattcggcaagaaccgcaaaaatggcgggcggcaaaagaaacagaaacgccggatggcctaaggcggaaagccaagcggtcaatgccagcgtcatgagggtgatcccgcgcctccaagcgggcggcctgatcatgcagaccgcgatgcccaaagacagataaagcagcagaaataagacggcgtacggcgtgtaagggcggtctaccgatacgaacaaaaaagccgtataaaaaatagcgatcagtctgctcatcagcatccaaaaatccataccgttcaacgcccgttatccaccttcccggtgatataaaaaatggcgatctgcgttctgtgctcaagccccgttttccctaaaatagatgaaatataattggccgtcgtcccttcagaaatgaaaagctgttttgaaatttccctgttcgagaatcctttcgcaataagcgacatgatgctgagctctctttcagtaaactggctttcatcaatctgatgcgcggcttccgccggccggaaaaggctgtcttttattttgtccagcacggtgtcctgaagaatgctgtgcccgttgaaaacgcttttgatcgcatcgcggatccgttccggttcggtgttttttaataaatatcctttcgcgccgtttttaattgcttctaaaatatactcatcgtcgtcaaatgtcgtcaggatcatcggcttcgtatccgtttcctcagcgatccgttttgcggcttcgacgccgttcatcaccggcatgcggacgtccagcaaggcgatatcgacggggttgtgcttacaatactctgccgcctcgagtccgttttccaacgttgctgatacagtaaattcctcatatgtatgcaaaatgattttcattccttctctgatgaaagaattatcatccgcgataatgacattaatcttcatagccgcaccctttgtgtgtttttgtttcattatataccatccgattttaaatcaaaaagcctcccggcgaaaggtgcgcggaaggcagatcggtcaagcgggctttttcaattggatgaaaaacagcatcagaaaagaaatgatcacaatacagatcacccacacccaggcgagtgtttcattgccggagtccatcgcgacgtaaatcgccgtcggcagcgtttgggtgacgccgggaatatttcccgcaaacattaaagtcgccccgaattcacctagcgcccttgcaatactgagaatgcttccggtcaagagggagggaaaggcaagcgggacggaaatacgggtgaacacctgccacctgccggctccgtctactttcgccgctccctcgatgtcagcatcaaccgcggcgaagccggttttagcggactgatacataagcgggaaggcgacaatggccgaagcgatcaccgcggccgaccacgtgaaaatgacgggctggtgaaaaatccgctcaatcgcccggccgataaagctgtgtttcccgaaaatgataatgagaatgaagccgacaacggtaggcggaagaacgagcgggagcataaacagggtctccacagccgtttttccgggaaatcgcgctttcgccatccaggcgccggcaagcgttccgagaatgatgacggcgatgcccgacgccaaagccacctcaaatgacagtacgacgggagtgaaaaactccgaagccgtaatgttacttggcagtaaatccatatttcttaaacactttcatcgcttcatctgactgcagatactgataaaacgcttctgcttctttacggtgctttgtatccttgacgatgccgacaggatacacgatcggatcgtgcgttttcgccggtgcttcatcggtgattttcacctttttcgaaatcagcgcgtctgttttatagacaagcccggcatcgacatttccggtttcaacataagaaagcacctggcggacgtcttttgcatagacggctttatcttttaccttgtcccacagggataatgccgtcagtgactgtttggcgtattgtccggccggaacggattcaggcgtgccgagcgcgattttttccgtgctgtcttttttcaggtcattcagatgtgtcaggtgtgcgctgtttttctcaggcacgatcatgacgagatcatttttcaaaagatccgtgctgtcctttttgtcgatatctccgtcatgaacgagcttttcgaatttatcttcggctgccgagaagaataaatcagctcccgcgccttgtgaaatttgtttttgcaatgtgcctgatgatccgaagttgtcttgaatggttacgtttgaatgtgatttttcgtagttggtctggatttcttcaagtgcatcctgagcgctggctgctgcagaaacggtcagcgtgacgttttcgttttgtccgcctttggacgattgtccggatgagcagcccgcagttgcgaggaaaacggccatagccgcagttgtgagtagtgtcgctttctttttcaacattgtgcaccccttatagctaaatatcattagatcaaactaattataacgcaattgtacgtgatggtgcggttttttttcaatatctgaacagttataataaaaacggagcgtgataatatgacagaagccacttcctatacaatagaagaagttgcgggccttttgaaggtctccaaactgacagtatatgatttgataaaaaaaggactcattccggcgtacagggtcggaagacagatgagggtcgatgaagaggacttaaaacaatataaagcaaacatgagaatgtcaaaaaagccatccgcagcagaagcgcctgacccgtcacgcgggcgggagccggaaaaaaggcagtctgttatcatcagcgggcaggatgtgtcgatggacctcctcagcaaacagctggaacaaacaatacaggcggctccgctccgcaagtacagcggcagtttgaacagcctgatcgagatgtaccgcggggcttgtgacatcgtcagtctgcatttatacgatggggagacggggcagtataacatcccgtatgtgaagcgcattctttcaggggagccgtttgcgctttttcatgtcgtgctgcggcaggccggattatatgtgaaaaagggcaatccgctgaacattcagggctttcaggacatgagccgaaaggatgtccgcatcgtcaatcgcgaaaaaggatcaggcgcgagggtgctgctggatgaacagctcagatcattcggcatcacgccgtctgatgtcgccggatatcatgacattgtcacggatcatctgtcagcggcttcacaagtatcaagcggaaaggcggatatcggagtcgggtcgctgcatgcggcgcatatggcaggcacggactttatcccggtgatcagtgagcagtacgatgtggtcgtcttaaaacaaaaccgggagcttgttcaaagcgtgcgggacattcttaattctgaggaattcaagtctcagctttctcaattatccggatatgatacgaaaatgacaggacggctcatatatgaaacatgaaaaatccctccatataacggagggatttttttattgcttataaaaccgcagcaggtcgccgtttaatattttatcggaaagcatcagctcttgttccgctttttctttctcatcgctgcacgcgctcatgtcagaaagcggttcacccgttttacggctgtaacacgtatttttcgtataaatatggtcatccgtgataaagctgccgtttctcagcaccgcaaacggagtccgctctccggaaaacagatcattgccgaactgaatgctgcctttcgtttcaatgccgagcaggtgaagcagcgtcggccttacatcaacctgtcccgcggccgaagcaatcgtttccggcgcacggtcggtcaccccgggaatatgaatgataaacggcacgcgctgaagctgaaccgtatcaaacggagtgatttcctctttccctaagaattcggcaagtccttgattatgggcttcggatataccgtaatgatctcccatcaggacgatcatcgcgttgtcatacagcccttcttttttcagcttcttgaaaaagtgtttcagagcctcatcttcatagcggaccgtcgtcacatagcggtttaataactcgctgcttgtgtccggttcctcaatgagctgatcctgttgatcaatttcaaaagggaaatggttggtcaaagtcagcaggcttgcgtaaaacggctgcggaagcttctttaatttttccgctgactgttcgagaaactccttatccttcaggccccagcctgttgaattttcctgtgtcaccttaaattcatccgcgtcgaaaaaacggtcgattccgaatgccccgtacatctcatcccggttccaaaaggctttatgattggcatgcagaacggctgaatagtattgacggtcttttaacatatggtacatcgtattgaaccggtggccgctttttgtgaaaaaaacggcgccgcttgaagacggatacagcgaattcgcagtaatgaattctgaatctgatgtttttccctgttcagtctgctgataaaaatgagtgaagtcataacttttttttcgcagtttgtttaaaaacggggtaatctcccgtccgctgacccgctcatccattacaaaacgctgtgttgattcgagcgtaacaaagatcacattgcgcccctttgcaagcccgaattttgaatcggacggcctgctgtagccggcttgagtgtaattcgcgaccgccgcaaggctgtcttcatcggcaaacgctttagcccctgcattcagcgtctgcgaaatggtgtcatacaaatgaaagtggaacaggccgattccttttacgagcgcttcacgatcaaaagggtgcttgaacagcttcggctgctcggcctcagacagcgcaaggttgcacagcatgaggccggctgatgcccacgcatacgctttaacggtacgggcgcccgcttttcctttatcggctttatgcctttttccaagataaaacaaaatcgcaatatccaaaaataaagcgatataaagcgggtgaaacagctcttggacgctgcttcccatatcacccatattgcttgcctgaaacaaaaccggtatggtgataaaatcaatataaaacccgtaaaacaccgtattcgcgattaaaattcccgtcagcatcacatttgccgaaagcagaaagatccgctgttttttttccgtcagcaagagggcgatgccgaacagcggcacaatgaagctcagcggattaataaggagcagacattcctcaagaaccgaattgttctgcagaccgaaaccgagcttatacacggcataggttttcatccacatgaacaggatggacaggcataaaaaccgatgattgctgaaaaaggttttcttcatatgtatgactcctcaccctaaaagcgaaaagacgctttttgtttaagagatgcggccgtgaaccagttcgtataaataatagcaggatacaatcgttaagccggccagcacaagctgctccgaaaagctccccgttctcatataaaggggaagacggaagcggatggcggacggaaacagcagtttaatgccgttgacggtccatgcgtcaagtacaagatggcttgccattccgatcatcagtccggcggaaatgctcggattcggaatataggttgccgtaatgaaaaacataataagcataaacagcaggctgtgtgtaaacgttctgtgcccgaacaccgtgcttacgactttggacagaacgggcagcgtcctgccgattttgcttttcgtatggcatatgtcgggaatcagcgccccgagggcacccgctgaggtcataaggaccggatcatacccgtaataatacgcaattgcggaacaagaagcgatgcctcccatgatgtgtgtttttcctgtcatttttcgcttctcctttttatttttgccaaaatcccctgaattacaaatatatcaagagaatgcatgtttgatcaacaaactttacctgttccgccaaaaggaaggagacgcggattccgcatattctgccgcggaaaaagacacattataggtgtacctatatttgataaagaggtgatacagatggctttctttaacaaagaaaaaggaaaaaacagcgataaaaacaaaaacgtcattcaaggcgcgcttgacgacgccagtgcagctctgaaagacgatccgcttcaagaagctgttcaaaagaaaaaaaacaaccgctgaccatataagacgggtagggcgaacgctctatccgttttccatctaatatttccctttgacagatctttttatctctgataacctctgagtagaattgaatgataaaaatcctcactctttctcggtgaggtagaggttgcgcttgatgatgagtcgcacatgccaggctgataaggggccgcaaaacatgtgttaaaggcatcagcgccgaagtgtaaagaaagccgatccttctttatgctgggactgtatctgaataagtgcaggactgccgcgtgctttttcgcggagggctatccggagatcaagggtgtgtgtgtttctttaagcatggacttttgttcaggctttttttgcgtgtaaatatggtctcggggtctggtccgtacgaatgaacaaccaggaggtacaggaatggaacagacgaaaaaatggggtttttggttattaacggcgtttgtcgtaggaaatatggtaggctcgggcatcttttcgctcccgagtacgctcgcaaaaatcgcgagcccgttcggcgccacatcggcatggcttttaacgggagccggtgtgttaatgatcgcgctggtcttcggccacttatccatccgcaagcctgagctgacggcggggccgcaaagctatgcgcgtgcgctgttcagcgatcggaaaaaagggaatgctgcgggcttcacgatggtgtggggctactgggtggcgagctggatcagcaacgtggcgatcatcacgagccttgccggatatttaacatcatttttcccgattttaacggataagcgtgaaatgttttcgatcggcggtcaggcggttacgctcggccagctgctgacgtttgccgtatgtacggttttattatggggcactcacacgatcctcgtcaccagcattaacggtgcgagtaaattaaatttcgtcacgacgttttcaaaagtattaggatttatcttctttatcattgcaggtttgtttgtatttcaaacgtcgtttttcgatcatttttattttcctgttcaaacaggtcctcacacggttgagggaatcggcggacagatccacaatgcggcgatttcaacattatgggcgttcgtcggaattgaatcggcagtcattttatccgggcgcgcccgttcgcagcgcgacgtgaaacgcgccaccattaccggattattgatcgcgcttggcatctatatcatcgtgacattgattacgatgggcgtgcttccgcatggtaagcttgtcggctcggaaaaaccgtttgttgacgtattgtacgcgatcgtcggcagcgcgggaagcgtcatcatggcgattctggcaattttgtgtctgttcggaacgatgctcggctggattcttctcggttctgaagttccgtatcaagcggcgaaatcaggagactttcccgctgcttttgcaaaaacgaataaacagggaagcccggttgtgtcgttaatcgtaacgaacgtaatgtcacagatctttatcttttcggttatttcccggacgatcagtgacgcgtttacgtttttaacgacggcggcgacgctcgcttatctgattccgtatctcgtgtcagcgttttacagcctgaagctcatttttacgggtgaaacgtatgacgagataaagggttcaagagtaagagacggtatcatcgccatccttgcctgcatttattctttttacgtcattattaccggaacggccgatttaacgacctttattctcggtatcgggctgtttttcgtcggtttgctgttatatcctttcgtctcaaagaaatttgcaaacaacagaccatcggtatgacaaaaagacatctcacgtctgtgagatgtctttttttgtttgcaacagcggattactttttgacggcgtgtatataatgaatggtctcaaatgcggttaaatggtcagtgcgtccgctgaaaaaacggtcattgacgtccgccggagatacatgttcataaataagcagacctgatgattctaatattttttcgatttctttataactgaaacacgataacatcggttctccgcctgctgcagccattttcaccatgttttccactctgtttgacagtcctctttcttcaaagagcgactcatctgcataatcaaacacgatagagcttcccggcgggacttcggcaaataattgtgtgagcaggcgggcgagatgctctttcgtaaggtagtatgacacaccgagcaggctgaaaaaggttttttggcgtgaaaaaccttcctgatacagacggctgaaagaaagcgaagcggcgaagtccatcggtacaaaatgaagatgatgggaaatgtcgagattcagatgtttcaatctgtttattttgtcttcctgtgaagcgggatgatcaatttcaaatatgtctaagacgtttgtcatctcaggatgcctgaaacagaaagtatcgagccccgcgccaaggataacatactgtttggccccgagcttcacttcattcaaaagcacttcttcacaatatgcggcacgggctaacggtgtaggagacagctgtacttgagtcacccattttaagatgtcatccggttggccttgaagcctctgtgccatgtctttactgaaaaatgatataccttgaatcagatgatcgcggatgtccgaatgctctttttcggaaatcagatcttgtgccataaaatcatcaaatatcaccggggtgtcgtatttactgtggtacgcccttccgaaagcggacagcagggaagtcatactcgccttgttttctttcatataaagatcctccgttatttacatcaatctccggccgggagaatcttattatacatgttaatccaaaaatgtaaattataacataaataaatttttttgtcaagttttaagcgtaataaaaagccgctgtgacagcggcttcggggttacttcgttaagctttttgtgatgtagtcgagctggccttcaagtgagatcgggtctgagaaatagaagccgatcggatcaatgcggtagacatggttttgtttgacggcatcgaggttcttccagattgagctgtcaagcacgcctttgtcgtcaccgccggcctgccatggccccataaagatgtagtctcccgcgaagtcaggcagtttctcgagtgaaatgctggcgtagcccggcccttgattaatggctttttcctgcgtcagttttgtggccttcagcccgagtttgtcataaatgatgcttccgccgcggccgaagtctttaccgaatacatagatgtcttttccgtttgtctgcatgatggagatggtttttgagccgaccgctttttgaacctttgttttagcggcagcggttttcttatcccattcagccagccatttgtctgctttatcttcagtgcctgtcattttcgcaaactctttgaattgatcaatgttgctgagcttgtcatatttaatggcgatggtcggcgcgattttttccagtttttcaatatcggcgccttgtgtcgtccagacaacgattaaatccggctttaagtcaatgattttttcaacggacgtgccgtcgccgatgtttgtgacaccttttgttttccctttgtaataagggtttttaaatacgttttgcggcgcgccgacaacattgatgccgagctgtttaaagtcgccgtagtagccgtcagccatgacgacgacccgtttcgggtgcttcggaattttaatattgccgttttcggctttatacgtgatggtttcttctttttcagaagaaccttttgtgtctgaagaattgccgcatgcggccaaagcggcgaagagcagcacggcaatcagcgctgcgccgattttcttgtatgtatggaacatctgacattccttctttcataaaaattagtgataaagagaatcattatcagtgtgattatatcactgctttcatagagaagcacgctctttttaaagaaaaactttctttttttatatgaaattaggtctattaaaagagaagataaaagtgctatactgaaacaagtcattgataatcattatcattaccattcttgttttgagaaaggaagaacgagtgttgggtctattgaaaaagaaacagacaatgacggctcaaggggcatcagggagtgaaatccagtggacggcgcgttcattccgggctgctgtgctgctgtgtgccggtattgcggttttattgatcggcgccgctctgtctgtttccatcggagctgccgatattcatctgcggacggtgtgggatgctctctttcactttcagccgcaaaatacatctcatcaaatcatacgcgatctgaggctgccgagaaccgccgccgccgcgctcgtcggggcttttttagctgtgtccggagcgattatgcaggggctgacgcggaacccgcttgctgagccttccattatgggcgtgacgtcggggtcaggatttgcgatcgcattggcatttgctttttttccgggtctgtctgcggcgggacttgttttgtggtcctttacgggagcgggaatcggagcgcttattgtgtttggcatcggcctgtcttcaaaaggcggtctgacaccggtgaagctcgcgctggccggtacggcagtcggctatttcttaacggggctttcaagcgcgattgcgatccgttttgatgtcgcccaggatgtgaagttctggtatgccggaggagtcgcttccgtcaaatgggaaggcatgcagctgcttttggcggtcggggttatcggactattgctggcatttctgattgcgcgctcagtgacggtgctgagcttgggtgaggaactggccaaagggctcgggcagtacacatcgcttgtgaaagtaatcggaatgtttgtcgttgtcctcttgacgggggcttcagtctcagtcgccggagccatttcttttatcggcttggtgattccgcatatcacccgatttttagtcggggtagattacaggtggatcattccctgttcggcggtattcggcgccgttctgttagtcttcagtgatattgccgcaagactcgtcaatgcgccgtttgaaacaccggtcggcgctttaaccgcccttatcggcgttccctttttcttttatttggcgcgcagggaaaggagagggctgtaatgaatgtaaaatcgaaaaaaccgctggcggtcatggccgttacgtttgtgctcatatgcatcgtcttttttatcagcttaaacatgggtgtgatccggattgcgccacttgatacgatgcgtgtctttttcggacagggggatgcccgggatcagctcgttttatttgaattcagactgccgcgcatggtgctgtcattgcttgtcggcgcaggaatcgcggtttcaggcgcgatttttcaaagcgtgtctcaaaatgacttggcggagccgggcattctcggtattaacgccggggcgtctttggcggtcgttctgtttatcttctttttccaagggtcagctgttgatctaagcatggccagtacatggctgcttccggtgagcgctttggcgggggcttttctggctgcgctgctcatctatgtgctggcttggaaaaaaggcgtttcacctgtccggctcgttttggtcgggatcggtgtcaatgcggggtttaatgcgcttctcttgatttttcagctgaaaatggacccgcgggatttcatgcaggcgcttgtatggatttccggttcgatttggaacgccaattggaaaatggtgctgtccattttgccgtggctgctggttcttttaccgttcagcctctataaagccaggtatttaaatgtgctccagctcggtgatcagctggcggcggggcttggcaccaaggttgaaaaggagcggcgcgttctgctgatgtccgccgttgccctgaccgcgtcatgtgttgcggcagccggcggaatcgcttttctcggactcattgcgccgcatttggccagaaggcttaccgggccgcgccaccagacgcttatcccggtttcagctttgatcggagcatttttatttctgcttgccgatacgctggcgagaaatgtgcttgcaccgtccgaagttcccgtcggcctggtgatttccgtgctcggagcgccgtattttgtatatttgctgatgaaaacgaaatagaggaaggagactgccgcgatgaactcattatcggcggaacagcttactgtcggttatggcgaccgtttgatagcgaaagaattggatatcgccatcccgaaaggaaaaattacaacgctgatcggtccgaacggctgcggaaaatcgacggttctcaaaacgatgtcaagaatcatgaaaccgaaatccggcgccgtctatttaaacggacaggcgatcatgcaaaaatccacgaaggacatcgccaaggaaatggcaattcttccgcagacgcctgaagcgccgagcgggctgacggtgtacgaacttgtttcttacggcaggtttccgcatcagtccggaatgggccgcttgagtgataaagaccgtgacatgatcaaatgggcgcttgaagagacggggatggccgaattttacgaccggccgatcgaagcgctttccggggggcagcggcagcgtgtgtggatcgccatggcgctcgctcaagaaacggagctgctgcttcttgatgaaccgaccacttatttagatctcgcccatcagcttgaaattttgcagctgctggacaaattaaacaaggagcagggccgcaccattttaatggtcattcatgatctgaaccatgccgcccgtttttcccattacatgatcgcgctgaaaaaagggcgcgtcatcaaggaaggaacggcggaggaagtcatgactcccggtatattggaagacgtgtttcaaattgacgcacagattgtaaaagatccgcgcacgaacaaaccggtctgcttaacctacgatttaatccggcatgaaaacgcaactgtaagatgaaaaaaaacgcagagccattccggcctgcgtttttttagtgcgcccggggctgcttttgtccggagacgcatttatccaaaacgaaaaaaacccccgccacaatcagctcctccgtcgttgacagccaaatcttttcaatcagtttatccgtcgtatacgcagtcatccagaggaacagcagctgaacggtgccggctaaaaggagaaaaggcagcctgcccgtcccaaaaaaggtaaagctatgtatcatcagccgttcaagcggttcaaaacataaaccgagaagaataaaaagcacggaaaaaagcaggacgtacgccatcgatccgtagctcgtcccggctaatgaaaatacggccatcatcacgatgaaatacccgaataatacggcagcggctgccagggcataccggagcacctgaagaaaaaacattttcgtcccgttttgattgatcatctgttcagctccttttcacacagaggagacttgcagagacggaactctgcaagtcgggtgtgtatcttcagcatttctttttgacgacagggtgtttctctttcgaaagaatatccgtaaagtctttgcccagatccagatgctgctggacgaatttctcaggaagcatggcaagccattggttcagggacacatcggcatagtggtcatccttgaagatttccaggaagacgagcggctcatcccccaaattctccacatagtggcccattgcgaacgggacgtaaccgacatccccggcctgatagttaaatgttcttgcatggccgtccgatgcaaaaaccgtcatccgtcctttaccggaaatataatactgccattcatgcgtattcggatgccagtgcagctctctcattgcgcccggttcgaccacgacaagcgctgaagcgatcgttttggacactttgaagtttgtggaatccgcgatatatactttgccgccttccgtctcagcagtcggaccttcatcgagcaggcggtaagtgaacggataaggcacttcgccgttcgggccttccacaatgtcgtctttcagcttcccgggaaccggctcttcaaagatgtatttttctttccgaggcaggccggcgaggtctttttctgaaaccccgaaattgttggcgatgacatcaagcggcgtgtgggcaagccagtcagtcacttggaatgtgctgttttctgagaaggaaccgtcatcaaaaaccaagaggaattcacagccttctttcagcgcctgaatggagtgcggcaggcctgacgggaagtaccacagatctccttccttcacgtcatcgataaaactgcgtccctgttcatcaacgatcgtgacccgcgctttgcccgtcagcatatatgcccattcggcttctttatgccagtgcagttcacggatggcgcccggttttaaacgcatgttgacagatgccagattttcagaaatcggcagctcgcgaacggtcacctcacgcgcgtacccgcccttttccagccggttatgcacatctgagaaagagaatttcatattatccactgtgccgtgatccgtttccggcggcgtcagcatatccggattttggcggtctctttcaagattgcgcggaatcgtgacggtcgctcctttgtctcctctgatcggctgcgggatattgcagttgttttcttttgacatgtaaatcgtctcctctcaagctttgttttttcagaaagagaatgtgaaaggcctttcgttttcccttctgctttgttaagtgatgcgttccgatgaaaagtcaacttcgtgtgaaaattaatttttcattttctgatctttcagttccgtcatcagttcgatcagggcgtcaaacttcttctcaaaccgtgtgagaagatacatagcaatcagagccggaaagccgagattgccgatctgtctgaccgcttcttctataaaaacctgatccattgtcagccacctcctgacttgacctgcagtcatgtatataagtgaaagaaagagcggctcctgtaaacctgatatcccggttgagggtctttttttttgttccggcaaatccgggacataaggaatgcggaatcttagtcggaaaggagtagtttacttttttttgctttctttcatttaatttaaatagggggcggttttatggactatcaagttcttttacggtcaaaatgcaaggaaattatgaaacatccgatcgttaaacattttttaagtgacccaaagcattacgagaaatttaaaaatgtgctggaacattcagacgagaaggatgcaaaatcattggacgaccattttaaacagttttataaggaaatccggatcatcaaatatatgaactctatgatccggattttctccatcgattttgacaagcgcatccgtaaaaatcagaatcgctatccgctgacggtggatcagccggagggaggtgaagcgcttccctatgaaatgggaaaagacgcgtatgaagagtttctgcggaagcagggagatttgagccagcatgtccaaaaccgtgatttatacgaagcgcttcagacgttaaccgataaacaaaaaagcgtgctgacgaatatttatcttcacggagcgacgatgaaagagattgccgagtcgctgggtgaatcacggcagaacatttccaatattcataaaaaagggctcgacaatctcagaaagcagctggacaagcaaaaaaagggggaaaataagcagtgaacgggccatttgacttcaacaaagagaacacagataccgacgaaatggaacttttgatttcacgtttttcgccaatgataaaaaaaaaactgagcaatacatcataccaggaaagagaagaccttgaacaagaattgaagattaaaatagttgaaaaagcggacatgctgttatgccaggaagtgccgggtttttgggaatttattcttcatcttataaatgaaagctcctgacaaaagcggcggaatgatggatattccgctctgacaacgtgagaaaaacgagaagagatgtccgtctcgtttttcttttctgtttccccgcaagacctccgcactaaaaaggtaccaaatcttatccatataatgatatgatgaaaaaaacaaagagaaaggaacgtccaaggtggaaaatgcgtcaattttaattgtagacgatgagaaggcgatcgttgatatggtcaaacgcgttctcgtcaaagaaggctatcacaacattaagacagccggaagcgctgaggaagcgattgagtttgttaaacatgaaaccgcggatctgctcgtgctggatgtgatgatggaaggcatgtccggttttgaagcatgcaccgaaatccggaattataccgacgctccgatcttttttctgactgcccgttcttctgatgcggataagctgtcaggatttgcattgggagctgacgattatataacaaagccgtttaatccgctcgaattggcggcgcggatcagagcgacgttaaaaagaacctataagcgcgaagagaaaacggcggtaaaaacgtattcatacagccatttttcctattcgccgcaaaacgccgagctgatcgtcgggggcgagcccgtcagctgctccgcacagcttctgcaattgcttcaatatttctgtgaacaccctgatgtggtgctctcaaaagatcagatctatgaaaaagtgtggggatatccgtcttacggcgataacaacaccgtcatggtgcatatccgcaagctcagagaaaagattgaaaaagaccccagcaatccgtcttatattgtaacggtgcgcggcctcggctatcggtttattcccgatcaaggagaaaaaggaatccgctcatgagaatgcgcggaaaatttctgctccactttttcggacagcttctgcttgtcatcctgctgatgtccgttttggccgtcgcttctttcttctatttggattggcgtttcagcgaagcggaagccaatgcgggactgaccaaagcgacggcagactcgtttgaagcgtggcttgataaaaacgaagacggcacatgggatgtcgatgaatttttaaagatgtcggtcagaaagcagaagggctggctgcagatcattaatgacaaagaaaaaacggactacgcatacagagtgccgaaagacgtcccgagccattacagcagaaaagacctcttatccatttaccagtaccggaattttgacaactacaagctgaattactggacggtcacgataaatgatgagacctatttgattctgttcggctggaaatccgccagtgagcagcttctcacttacatcgaatcacaggagccatccctcgcttccctttctcaatataaaaaaagcacggttgattatattaaacgggaaaaaggggcggtctaccttctcgaaaacagcggcagactgctcggggatatcaacagcacgaaaaaagaacggaacaccgtcaatgagcttgaattgctgaaatacagttccaagccgtggaattacaaacgggaaatttcttttaaaagactcgataaaacgaaatggatggtcgcgtcggtgccgaaccccgtgtacatccccgatcacgagtttaacaaatcatttttgagaaatgtgatgaaaaccctcttcctcttgatcggaatcttagtatttatgatctgcatcctgaccatctggtactctttccgtttcggctggccgctgtttcataccatcaaatggcttgtcaatttatcaaagggccggcttgaagagccgaagaaccgcaaaggacagccggtcagcaaaaacaaaaaaggcaaaacaaaacagccgttccgctttttcgccgagattttcgaatcgatggatcagctgaccgacacgctgaagcgggataagaaaaacagagaaaaaatccaggcgacaagggaagaatggatcgccgggctgagccatgacttaaaaaccccgctgagcacgatttacggctacagcatgatgcttgaatcgaagcaatacgactggacaccggaagaagtcaaagaaatggggcagatcgtccgggaaaaatcagaatatatgtctaagctgattgaggacttaaacttaacataccgcctcaaaaacgcggccctcccgatcgaacggcggctgatcaacgtcgtgccgtttatcagaaacgtcacgaacgattttacgaaaaacacgttctcggaaggctatgacatcgcctttgaaaccaaaaaggaagacattcttttcgccattgatgaagcgtggttccgccgtattctggagaatctgctggcaaacgcggttaagcataataagaaggggaccgccattcgggtggtgcttgaggaatcagccgaacagctcattctgaaggtgaaagataacggaagaggaatggacgatgaaacgattcaccagctgtttaaccgttattaccggggaacgaatacgaaggggccgtcagaaggaacgggactcgggctcgccattgccaaagagctggttcaccttcataacggaaccatccatgtcaacagcagaatcagcgccggaacggtgattacgattctttttaaaaaagattgagtttggacgccgctttgtcgggaataacaatagaagactgacaagcaaaagaggtgttcacacatggaagcagcattacgagcagatacgagagcagttatcggagaaggccctttatgggacaaggataaggaatgcctgtactgggtggatatactgggcagccagctccatatcttcactccggctgacggaatcaaccgttccgttaaattcaactcatttgtcacggctctggccttgtattcaaaggaagagctggtgatgacgatgaaagacgggttttacctgtacaatctgcgggaagacacattgacgaagatgaagcagccgaaagacatgcgggaagatatccgtttcaatgacgcaaaatgcgacccgtccggcagattatgggcgggaacgacgagcatggaaggcaaagaagaggaggcttcgctgtaccgtctgaatacggacggcagccttgccaaaataaaagaccaggtctccacctcgaacggtttggattgggatcgggaccgaaacctgatgtactatattgatactccgacgcaggaaatcgtctgttatgcatatgatcctgaaaccggagccgtatcagatccgaaaacggtctaccgctttccggagtcgcaaggatctcccgacggaatgaccattgaccgtgacggaatgctgtgggtggctctgttcggaggcggccgcgccgtccggattgacccgtttttgcataaggaaattgcatctatcgaagttccggcgaaatacgtcacctgctgcgcgttcggaggcagcaatttgaacacgttatacattacgaccgcgacggaaaaattgacggaagccgaaagacttgagcagccgcatgcgggcggcctgttttcagcagagcttgagacgggcggctgggagccggttccgtttgcaggcatgatgtaaaaaaaagccctggcatatggggaagttccccttgtgccgggcttttttgtgttaaatggagcggatgatgccgccttcaacccgctgtgcggtgccgttaatggcagaagcagctgatgaagcgagaaatacaatcgtattggcgacttcttccggggttgcatagcgctgaatcaaagatgtcggttcattcactttaaaataatcccggacgaagctgtccgtgtcttctccggcagcctttgcggctccttccatgtaagaagcgacgccttcggtccatgtcggtcccggcagcacggagttgaccgtgacattcgtgcctttcgtcatttccgccattccccgggacaagctgattaacgccgttttcgtcattgaatacggaatcatttgcgcaagcggtttgactccggcttcactggagatgttcaaaatccgtccgctgtttctttcaagcatttgcggcagaaaacgccggcacaggcgcacggcgctcataacattcacttcaaaataccgagtccattcgtcatcagacacctcagcgaagtcctttacttcaaaaaaaccgagattattgacgagaatatcgacttccccgattccgccggcgcgcttgatcaggtcatccgcctcatcctgacgcgataaatccgcagcgatgccgtgaaccgttccgtaagcggaaagctcctcaaccgtccgttccacggtttctttttttcttccgtttacaatcacctcggcgccttcggctaaaaagctttttgccgcggcttttccgatccctgaagttgatcctgtaatcaatacgagctttcgttcaagctgtaattccatgataatcctccttattacaccattgtgtaacagtatacatgatgaattttagtgtgtacgaacaatttgctttcatgcaaaaaggccggatatacaagccttaaagacttatagtataattactgcgaaaaaaggatacgaatgtcaaagagacaatcgtttaccataatcagggggagttaaaagaatgaagaagatcactgccgtctgggcggcgctcttggtcaccgcctttgtgatcgccggctgttccggcgcacaggaagaaggaagcgcggccaaacaaaaagccgtctcaaccgaagcattcccggtaaccattaaggatgccgcgaacgaaaaagtaaccataaagcaggcaccggaaaaaatcgtttccctcatgccgagcaatacggaaattacatacgcgctcggactgggagataaggtcgcaggcgtcacgacaaatgatacatatccgaaagaagccgtaaaaaaaccgaaagtcggagatatgaatgtgaacgctgaaaaagtcatcgcgctgaagccggatctcgtgcttgcccacgcgtcctctatgtccgcttccgccgatgcgatgaagcagctgaaagatgcgggcatcaccgtcttaacggtcaatgatgcgcaatcgttccaagatgtgtacaaatcaatcagcatgatcggaaaagcggccggcaaagaaaagcaggcggatcagctgatccaatcgatgaaatccgacctttccggcatagaaaagaaagcggcggccatttctgaaaaagacgaaaagaaagtattcgtcgaagtgtctcctgacggctacacgacggggaaagacacgtttatgaacgaaatgcttgaagatatacatgcgaaaaacgccgccggcagccagaccggctgggtgcagctgacggatgaagcgattgtcaaaatgaatccggacgttatcatcacgacagacggcgtaaaggccgctgaagtggaaaaacgcgccggctggggtgccgtcaatgcggtcaaacaccacaatgtctattctgttgatcctgaccttgtcacacgctcaggcccgcgccttgtcaaaggggtcgagaagcttgcagaaagcgtttatcctgaaacgtttaaaaagtaaccgcccgctggcctacacggtcagcctgctgtttttagccgtttgtacggcactcggcatttcaatcggcagtctgcatattcctttatccgacgttttttggatcgggatcggccggacatcctctgttgatcccatgaatgtaaatattatgatcaatatccgcctgccgagagtcgttctggccgctcttgtcggagccgcgctatccattgcgggggcggcgtttcagggacttctgaaaaatccgctcgccgacccttatacactcggggtatcttcgggagcctcggcgggagccgttatcaccttgtttttcggcattcagattcccgtcatcggccggttcacacttccggttgtcagcatcgccgctgccattgcggttatggcggcggttctgtttttcagccgcctcgttcatgcgtcgatgtcggtttcgacgctcattttgacaggcatcattatgaattcttttctcggggctctcatttcgcttgtgattgctttaacgggaaatgatctgctcccgattgtccgctggctgttgggaagcgtgtcaatgaggggctggggctatgtcgcgctgtttctgcctttttttctggccgggacggcgcttctgcttatcaatggcagagaattaaacattatgacttatggagaagaaaaggcaaagctgttaggcgtcagtacgggaaaaagaaaactgctgatgatcgccgccggatctctgttgacgggaggagcggttgccgtctcggggacgatcgggtttgtcggccttgtcattccccacgtgacacggcttttgtgggggacggatcatcgccatttactgccgctgtcagcattgacgggcgccgggtttctcattttggcggatttgttttcccgcaccgttattgagcctgtcgaattgccgatcggcattatgacggctttggcgggagcgcctgtgtttgccttgattctgcttcgccagcatcatggagggaaacgcttatgatcagggtgagcagcctgtccggcgggtacggaggccggatgattgtagaagatgtcagttttaccgccggaaaaggtgaatttgtcggcatactcggtccgaacggctcgggaaaaacaacgctgatgaaattgctgacgggaatgctctctccgtcaaagggcgaggtgctcgtcgcaggcaggcccgcgggcagatacaagccgcgggagcttgcgaaaattatggccgttttgccgcagcatacggagcaagcttttacatttaccgttaaggaaacggtgtccttcggcagatacccgtatcaaaaaggactcttcagacagatggatcaacatgacgaagacattgtccgggaagcaatggaaatgacgggcatcgaccgatatgcacagcaatccgtccgcaatctgagcggaggggagcggcagcgcgtctatctggcgcaggcgctggctcagcagcctgaggtgctgtgtctggatgagccgacgacctttcttgatctcaaatatcaaaaagacctgcttgatacggtgaagcggctgacgagagaaagaggcctgacggtcatcagtatttttcacgacctcaacgtcgcaagccaatattgtgatcagctcctgatgatgaaagacggacgcgcttttccgaagcagccaccggatcaggctttgaaaaaagagacgattgaagacatttacggcattaccgtcagcgctgttgcccggcaatcgtcgccgaaaccgctgatcgctttcatgccggaagcgcgggaggaaagagagcccgccggcgttccgttcgcctctctgataaacaaaagcggaaataccgtaacgcttcatacagaacggccgtttagaatgctgtcaaccgcatctgacggcccgggcttttcgtggagccgccggctttccggctcggcggcagctggtttgatctgccgtacgtttgattcggttacgatagccgtgactgcgcagtataccgtttgggtgctgatcagcggacgtttatcggaacagggatttgttcggctgttaacggcagcggctgaagcgagaatgcaggctctttccggcagactggcaaaaggcgacattgccatttgtgccttgcagacaggagaggcaatggacgtccctcacgcggaaagagccgtcagaagaggaaccgcggtatgtgtaaaagcggcggaagaaggaggaatacaacaatgaagctttatacgaaaaccggcgataaaggacagacaagcctgatcggcggcagaacggataaagacagtctgcgggttgaaagctacgggacgatcgatgagctgaacagctttatcgggcttgcgcttgcggagctagataattgtgagaattgcggtgatgtgaaagccgaactccgaaacattcagcatgagctgtttgactgcggcggcgacttggcgacggtcactgaacatagaagctatacattaagagagacatctatttccgcattggaagactgcatagaccgttacacggctgaagcgcccccgcttgagaaatttattcttccgggcgggcataaggcggctgctcagcttcatatcgcgcggaccgtcacaagacgggctgagcgtctcgtcgtgaaactgggcaaaacagaagagataaacgatacggtgatgcgttacttgaaccgcctgtctgattattttttcgcggcggcaagagcagttaacgcaagacagggcgttcaggatatagagtatgaaagaagcgccgcggtattccgtgatgatgaataacgttttgttcagccggcagcagcaagccggctgtttttttatagagatatccatcaattgaacctttattgacagaaggaaaatgtatcttatgcattattgactgaaaaattaaaaaatgagatattataagaaacattgtaaaataatgggggatttgatagatggatacatataataagagcgagagcatctggaataaaaatttcacccttctgtttatctcgaggcttgttaaattgtcaggcgacggttttgcctttaattccattctgtggtttttgatttttgacggggaaggcgcgatcggcacgtccctgctcattgcggtcacgttccttccggaggcgatgctggcgccgattaccgggccttttatgaagcagcatacgctgaaattctggatgtatttctccgatctcacgcgcgcggcggtcgtgttgatcattccggtctgttactttaacggtttttctcctttatggtttgtcatgcttctcatgattttgcattcagccacgggagccgcttataatcctgcatctatctcattaatccccaatattgtcggagaaaacagcctgcagaaagcgaatgcggtcatccagtcatcaggccagatcgtcagacttgccgccattacgctgagcggggtgttcttaacatttatcagtcccgcttattctttgtttatcgctcttatattctatcttctatcaggttttctcgtactctttatgtcataccaagtccagcatgccaaagaggataccgtcgccgtcagacagcgcgggacgtatgtcggaaggctcaaacggggtttcgttcttgtcaggaaacaccagattttatacccgctcgccatctattgtatcttcatgaattttgcggccgctccgtgggaggcgctctctgccgtttatgtcgccgaagatttaaacatgccgccgatcatctactcgcttttgaaagcgacaggcacgggcggagcctttttaatgggttttattttggctaaggtgaaggtgaacaaatacggtctcctgtttgtgtcagcgggaatcatagaaggggcggcatttttcatcaccggcctcaacacttttctgccgctcgtcttcctcgccgcgtttgcgttcggatctgccgtcagcgcgattaatgtgccggaatatacgattattcagacgtctgtggaccatgatgatcagccgcaagtctatgccgtcatccatatgatctcaaacatatccattccgctcggcgcggttctttgcggatacgcggctaacgccttcggtcccggaaaagtcattgccgccggcggtctcgttgaagtcctgtccggtctcggaatattgctctttacgaagctggccaaagctgaacgctcagatctcatcagggaaaaagaagcgagcatcagaatatagatttttcgtgaaacgccctgcgccgtccggtgcagcggcgtttttttatgcgaaggtccggggggttatacgactccggtctgatatgaaaatcaatctctgactcgttttgccggccgcgggatttgtttatagtaaagacaaggaaaacgaaaggaggatctgcatgaatataaatgtaaaaacggcaggcggctttctgctgattgtgttcggactttctgtctttttcggaggaggccatttcgcatttatcatcccgctggcgatcggaggcctgatgctttactggggaatcaaacgtttttcaaaaggccgggcggtatcgggtatcatcgcgggcttcatcggagctatgattctcgtcggttctcttccatttatcgttgccatcggactggctggcgccatggtgtatttcgggtggaagatgatgaagcagggcggctcagacaccgcttcccgccagtatgaaccggaagcggcatcaccgggctatcaatccggatttgactctgaatgggaagaatttctgaagaaaaaataaggaggaagacaaaatggtcttaaaaagaataagaaatatgttcgtcgcatctgttaacgaagggcttgataaattagaaaatccgaaagtcatgctgaatcaatatgtgcgtgatatggaaagtgacattgctaaggcgaaacaaacgattgtcaaacagcacacgatcgtccatcagtttaagaaaaaacaggaagacgcttccgaaacggcggcaaaacggaaaaaccaggctcagcttgcttttgacgccggggaagaggagcttgcgaaaaaggcgctgactgaaatgaaataccttgagggaaaagcggccgaacatgaaaaagcgtatgagcaggcgaaaacacagctggcagagctgaaagagcagctggaaactttagaaacgcgcctccgcgacgtaaaggataaaaaacaggcgctcatcgcccgcgccaacgcggcaaaagcgaaggaacatatgaacgcttctttcgacaaaattgacagtgaaagcgcctacagagagtttcttcgaatggaaagccgcattgaagaaatggaagtccgcgtcaaatacggcacttcagctgaggcgaacacagaatacagccgctcccaatattcagacgaggtggaagctgagattgaaaaaatgcgctcgctttctctggagaaaacagagcatcaaaaagcggctcatgaataatgtgcacaagggaagatcggcgcttttacgcctcttccctatacgcacgtatcaattctccggcttttcctttataataaaatgaatgaaaaaggatggaacgtaatgaagcgtaagatggccaaaggactgatggcggcgtccgttctgatctgctgtctgtttttggtgaaagaagtgtttgccgggcgtttttttccgctgtacgaaacagaagcggaatcggcaagcataccgccgcgtgccgtcaacagcctgtcggtttcatcggaacagacggatgtaaaaatcatcgcggaagcgcggaatgatatcgcggcaaacatggcgggaccggcggggaaaatgtttgtccaaagcaggggaaaaaccctcaatctcaaagcgaaggagaaagggttccaatttctgaatctctttcagcgtcctctgctgattgtccgcattccgtatgattatcatcgggacattaccgtccatacgtcaagcggcaccattgccgttgacggaaacaaggggctgtctcttgcgcacctcggcgtccgttctgtaagcgggaatatgtcgctgaagcacgtgaagacggatgtgtttgaagcgaaagggctgtcgggcaacctcacagcatcaggccttgcggcgaaaacgggggatatccgcttatcctccggacatgtcgggcttcaacatgcggcgggcgcccttgacgtgcgggtcgcttccggcagtgtcgacgcctcgcttgagatggcggatgctcccgtatccgtcaggcttgcgagcggcagcgcagcgatcagcctgccgaaagacggaagttttacggtgaacgccgagacggcaagcggaaggattcagccgtcttattcctttgagaaaacgagtaaggacggcggggcattcaccggtatgaagggcagcggcgccaggccgattgatataaaagtgacgagcggcaatattgcactgcaatagtcaaggaaaggaggggcaggcagctgatggcaaaaaaacagattctcggacttatcatcgccttattaggcgtcagcatgtttttgcgtattatcggcatcggcgacttcttgttttggccgctcttttttctgatcacaggctatatttttaataaatattcccgcggctggctcggctccgtcctgtatatcttcgccgcttttttatttttgaggaacctgttcagcgccacctttaacctgttcggctatgccttcgccgcctttctcatatacgcgggctacaggctcctgaaaggaaagcgcgtgtatgaacataaagagaagaaaatcaatcttgaaaaagaagagcagccaaagccttccgcccagacggaaagcagacagccggacctccgcagcttttttatcggcgagctccggatgatgaaggacccgtttgagctgaatgatttaaatgtttccggattcatcggcgatgtgaaaattgatttgtcaaaagcgatgattcccgaaggagaaagcacgatgaccatcagcggtgtcatcggcaatgtcgatgtgtacgtcccgccggatatcgaagtgtccgtcagttcatcggcttttatcggcgatatgaacctgctcggctctaagaaaagcggcatgagcccgaatctttataaagtatcgtctgagtacggcgactcgccgcggcggattaaaatttcaatttctttattcatcggcgatgtggatgtgaagtatttatgaggaaaaaattactcgccaatattcagtggcgcgccatgcggatgactgcggggctcagtctgctcctttgtgcggtgtttattacgctgatgctgctgtattacgggcttgacccgatgctgctgttttcttccggctggttcggtattccgtttgtggtcatcctgcttctggcgtctctttcggccggattgatttccggttatgtatacggcggccgcctgaaaacaagaatggatacactgattgaagcggttttgaaatttgaaaacggcaatttcgcttatcgggtgccgccgctcggcgatgatgaaatcggcctggcggcagatcagcttaacgaaatggccaagcgggtcgagctccaggtcacatcgctgcaaaaactctccaacgagcgggcggaatggcaggatcaaatgaaaaaatcggtcatcactgaagaacgccagcggctggcgcgcgatctgcacgatgccgtcagccagcagctctttgccatttctatgatgacatccgccgtcttagagcaggtgaaagatgcggatgacaaaatcgtcaaacggattcgcatggttgaacatatggcgggggaagcgcaaaacgagatgagagcgctgctattgcatctgcggcccgtcactttagaaggaaaaggcttaaaagaagggctgattgagctgttaaaagagttcaaagcgaagcagccgctggatattgagtgggacatcagcgatacgggtgtgtcaaaaggtgttgaagaccatctgttccgcatcgtgcaggaggcgctttccaacgttttcagacattcaaaggcgaccaaggtcaccgtcaggctcggcgcgaaacatcaaaagctgcagcttaaagtcattgataacggggagggttttacgatggatcaagtgaaagcatcctcatacggcctgcattccatcaaggaaagagcgagtgaaatcggcggcatagcggaaattatctccgtgaagggaaaaggcacgcagatcgacgtgaaagtcccgatttatcagaaaacaaaaggagagaacgacagtgattcgagtgttactgattgatgatcatgagatggtcaggatgggtctggccgcatttttagaagcacagccggacattgaagtcgccggtgaagcatcagacgggcagcagggcgtcgatctggccgcagagcttttgccggatgtgattttaatggaccttgtcatggacggcatggacggcatcgaagcgacaaaacagatctgcgcgaaactcaatgacccgaaaatcatcgtgctgacgagctttattgatgacgacaaagtgtatccggtgatcgaagcgggagcgctcagctatttgctgaaaacgtccaaggcggcagaaatagcagaagccatcagagcggctgccaagggtgaaccgaagcttgagtcgaaagtggcgggaaaagtgctgtcaaggctgcgccattcagagaatcagcttccgcatgaaacgctgacgaaaagagaactggaaatcctctgtctcgtcgcggaaggcaagacgaataaagagattggtgaagagttgttcattacgattaaaacggtgaaaacccacattacgaatatattgtcaaagcttgatgtcagtgaccgcacgcaggcagccgtatatgcccaccgcaatcatctcgtgacataaaaaaaggagagcggcgccggcacactctcccgagggacggggtcattgggacattccctttgttccgaaatccctgatggcgactttgactttgtattcaatatccgattcactgaagtgatgatcccagtcagaggatatctttttccatttatcaggataatgaatccggacttgatcgcctaacccggtaatatccactttcaactcatgctgcatgtaatcaatgaatgccataacatctgaatgaatgctgcgttttaccgcgtttttgatttcatttatataggactccttgaaagaatcttctttcggattccaatcctcagacagacggccttcaacaaaccgggtgacgataaacttgaattttccgtttttatattgtgtttttacattatatttgctggaaaatacctcgaaagataaataataattgtcatgctttgcaaacgtgacgcctccctttaccgtgcctgtgaacaggttcatattctggacttgtaaaggcgttaaatttgcataccagaatttatttttaataatggtagcgccccagatttccagtctgctgcccactttgcgcacttgaggaagggcaaaggtttcgcccttggcgattttctctgatatttcccccaatgtcacgggctccatcatccggatggtgaccgaattattctccgttaagtcatagatcgtatttgacgcaggttctccctggtcactgatattgaaaatatctttcgttttatccggcaccgtcatcacattgcagcttcttctcgtaccgttgtctctgataaattggttcatcaatgcgtcaagcggaatgtcatcctttaacagcgcttcggaaaacagcatgatacgcaagtgctgggagaaggcggggtgattttttaacgatgccgttcttaatgcttgatggacggtttcccctggagtggaagtcacctttgtcgtgtcacctgacgacgactgctgggcacttgctttttgcggaaccagaatctgctgtgtcacttccacattttcttccgcgggtttatctagcccgactccgataacgaggctcaagtcttctaaattgcggctgtcccagcacccggccaaaagcaatgtgcaaaatatgattacgatgtatttcttcattgtgcttttttcaccttccttttcacagcgacgactgcaaacatcagtaaaggcagcaaaaagaaaaccaagaagatatagccgagaatatcactgaacagcatcagcttgtttccgtcttttggcaacaatgatccgaagaatgtcgcgatgcctacgaagatgatgccttttttctgtttcagcccgaaaattttatgaagagctgatgtcgcgaaatatccgtatgatacataggtggcgaaaaactggatgatccagacaacaagcaaaaaggactcgaacctttcaataaaaagccctttgatttcaaatgattgaaagagcgcgatcgttggccagatcattgttttgacatcctgggtggttaaggcgccgacgacgagaacgtaggtaatgatgtataaaataatcgggatgccaaagcctatggccgacatgcggaatgtgtgctttttatttttgaggtactcggggagaaacagcataatctcaattcccaagaaggaaacagaaacgacggtcaaggaagccataacgggagaaaatccctgcccgagcaccggccgcaggttgtccagatcaaatattttaaagctgaaagaaaacaccaccagcaaaataatgatcgtaatcgttaaatagaaaggaaagagcctgccgatatcgctcatgccgccgataattaaataaacggaacaggcgataaagataaacagtgtgaccggcacgggcgttctttccaataaaaagaacttgaccatttccgccatcgcccgggcttcgaagctggcgactcctataaaatagagacagatcatcagattgacgatatttcccgcccatttgccgagtccttcattcatataatcaaataatgatccgtactgatgctttttcataatgagcgtattgagataaatcaaaaagataaagatgacgccttccagacataacgcgatccagccgtccggcgaatttgccctggatgacagcgcccgcggcatggtgaggagccccgcgccgagcatcgtgtttgcaatcaatgctgtcccttgatagcttgtaagcttattgtgagttgttttctggctcatttacgtttttcgcctcttttggttgatttttaatagggagacggagaatagagtcgtttgcgttttttaagctgaaaaatccattcggcgagaaatacggagaaccgaagcttcgctgtctcgataaatgagtgtagatcgccagcataaataaaatcatgccgtacagcccgaaagctgccgcggtaaacatcgaaataaaacggagcacacggaacgacagacccatcccgtactgcggcaccgtaaatgaagcgagcgcgacaatgctgaccacgatgaccatgatggagctgacaatattcgcttcaacggccgcctggccgatgacgactccgcccaccaatccgatcgtctggccgagcgggctgggaagcctcaagcccgcttccctcagcagctcgattgtaatttccattaccatcgcttcaatgataggcgggaaggggacgttttctctgttcgccgcgatggtgactgcaagcgacgtcggcagcagcccttggtgaaacgaaacgagggcgatataaatggacgaaaaaaacagcgtgataaaaatagacgtaaacctgagcgcccggatgagcgaggcggaaatccaccgttcataataatcatcgggagactgcattaaaattcctaaagaagccggaaccaccagcgcaaacggcgagttgtcgacaaggatggcgacgcggccgttgaacaaggcggaagagactttatcaggccgttccgtattttgtatttgcggaaagggcgaatacttattatcctcaataagctcctcaagcgttccggaatcctggatgtcatccatcttcactttgctgaggcgctttacaacatcgctgacgacagacgggtccgccttatcatctatgtacatgaccgtggcgtattttaacttattttctccgatcggaacctttttcgttttcagcttcggatggttcgtgcgctgcctgatcatggcgatgtttgtatcagaatcttctatgaaggcgattttcggacctcttacgaccttttcggatgtgggttcatttacgcttcttttttctctttttcccgtggacaaaatgtatacgctgtcaagtccgttaataaacacggcgcattttccccgcagaatggagatgacggcttccttcgacgtaaagacgggacgggcgttgatcttatcaagacgtttcgccaccgtatccagcgtcagagtgtcttcctcctgaagcagcgtttcaatcgcctcttttattttgtcttcgtcgttcatttcactcagatacatataataaaaaacaagcccgttcggaagcatctttttattttgaaccaggtcatcattctgctctacgtggggaagcaccagtgccagattaacgtgtatgtattccttgaactccgattgcgtcatcgacagtcacccgccttccaatccttaattgaggttatcttttcctgttaaaaaaatgatatactatgataaagtatttaatggtacaagtttttttatgaaagcggaggagagatgtggcacaagtcagactggcaggaaatgccgaagaaattgaacagctcatcaaatcatttgaagcgcattacgaagtggcttacacgtcgaaagaataccgtaaaacaaatccgaagtataaatactctaaggattcgcgcgtctatcttgagctgaaattaaaaacggccaaggccgaaaaataaaaagggtttcatctgttactggcgaataatactcagggtgaagcaactgttatggagggatacataaatggactacagaattgaaaaagacaccatgggagaagttaaagttccggcagataaattttggggcgctcagacacagcgcagcaaagagaacttcaaaatcggttcagaaaaaatgcctcagcgtgttgtgaaggcgtttgcaatattgaaaagaagcacagcgatcgccaacgaacgcctcggcaacttagagtctgaaaaagcccaggcgattgccgctgtatgtgacgatgttttaaacggcaaatacgacgataactttccgctcgttgtctggcagacgggaagcggcacgcaaagcaacatgaacatgaatgaagtggtggccaaccgcgcgactgctttattgaaagaaaaaaattccgagctgaagattcatccgaatgatgacgttaaccgcagccaaagctcaaacgatacattcccgacggcgatgcacgttgcggcggttcttgccgtatatgagcagctcgttccggcgcttgatcagctgcgcgcgacgcttgatgaaaaagcgaaagcttatcaggatattgtgaaaatcggacgcacgcatttgcaggacgccactccgctgacgctcggacaggaaatcagcggctgggtatacatgcttgaccgttcgaaagaaatgattcttgagtcaacggaaaaaatccgcgcgcttgccatcggaggcacggcagtcggcacgggaatcaacgcccatccgcagttcggtgaattcgtcgcggaagaaatcacaaaagtaacggggcagacattcaagagttcgcctaacaaattccatgcgctcacaagccatgatgaaatcacttacgttcacggcgcgttaaaagcattggctgccgacctgatgaagattgccaacgatgtcagatggctggccagcggcccgcgctgcggaatcggcgaaatcgtcattcctgaaaatgagccgggaagctctatcatgccgggcaaagtcaacccgacgcaaagtgaggcgctgacaatgatcgccgcgcaagtgatgggaaatgacgcgacaatcgggtttgcggccagccaaggaaacttcgagctgaatgtcttcaaaccggttattatttataacttcctgcagaccgtgcagctgctcagtgacggaatgaattccttccatgacaaatgcgctgtcggtattgagccgaaccaagagacgattcaggaaaatctctctaactcattaatgcttgttacggcgcttaacccgcacatcggttatgaaaacgccgcgaaaatcgccaagcttgcccacaaagaaggcctgacactgaaagaagcggcattacagctgaaccttctgacagaagaacaatttaatgaaatggtgcgtccggaagatatggtgcacccgaaagcataaaagaaagaacggctgcagtcattgcggccgttcttctaaataaactgctgtttcagtaaaaatctgagctgttctgcatcttcagccagcaggtcggattccttcaaattcaaaatcattcctttgatgattgccggtttcggcgactttttcttcatttccgcttccagaatatccaagctctcggtgaattcagatgcttccgccttgtccatcgtgccgatgcgcgtgcggagggtctgcaagatcgattggcttaaaggatcgggctgcccgttatgaaggggcccaaacagtgagcttgcctcatcaagagaaataaatgcttcatcatgtctgcccgccattccgtttacgatgtcatcaattctgtgaatcacggtatttgccaaaagcgaaggctgtacggaccggccggtcagaatgagatattcaagatacatctgactgattccttctattaaaaaacaaagctcggctgtgtatggttcagctttttctccgtaaacagcaagaagactgtcgatatgaaactgcaggatcgaccggcggattctctttccgcactgcgccgcttcttcggtataaggaagtgaaccgtctttcatctgcatggtaataaaatcctgatgggcgagaatcgattcgtaaaacaccgcaagctgtttttgataagcggctctcggactgtcaccctccgtttggatcgtcgtgattcgggtaaacgttttatcatagtagtaattcagcatggataggagcagtgcttctttggaaggaaagtaaagataaaaagcgccttttgagattttgcattcatcggcgatttcctgaaccgatgtagatttgtacccttttcgggcaaacagtttgattgctgcttcaatgatcagcttttctttttccttcaatggttccaccctttcggagccaggaggctggcttgtgcttctcatgtatgactatatggtcatattgatattccgtaaatttaacctgattgtaacttgtttttttgttttgttttatttatattataaagtgagctgaccgaatggtcaaagttctggcgaaagggtgaatctgaaaatgaaagaattagatgaaatgatcagccgcttgcgaaacagaggaattaaagtcgaaaaggtgaaatatccgaaaaagacaatttgtgaaaagaaatgggttcatcaatgccaaaaaccgctgaaagcaaactacagagattttaacggctattccttcacataaaaaaagactgcaatgaaacactacagtctactttggtatgataattcggtagattacacccgattggtcattttcaattgaaattgatgctttatgcagggttaaaatccgttttacgatgctgagtcctatgccgaactcgcctttcttccctttattaaaaggctcgtacaagctggatagcatctcatcctcaatcggaggcccgtcatttttaaccgtcatgacaatctgctgctgattttggctgatccgaatgtgaatcgccgtttctgcatagcggatttgattttcaagaatgttttcaagaagtttgctccattgttccggatcaccgggcatcattaatgcatcttctgtatcaacgctccacaataattccttccgggcccatttgagccgttcaatgacttcttccgtgaccttcacaatgtcaaatgtctcatggtgcacccgctgcttcattaaataatcaagcttcgttaaatataataaatccttaattttcttctcaagtttttctgcttcgccttcaatgacatcaattgtggtttccagatcccccttaggaaaaatcccgtcctttattgattgagtatagccccttatcaccatgacaggcgtttttaaatcatgagagatattttgcaggagcgttctttccgtttcatccttttgcaccagcttgctccgcatgtcttcaatggtatggcctaattttccgatttcgtcttttctgtcgacgatgaccggatcatcccagtcctgttcggaaatccgtttgacatgcttctctaaggaaacgagcgggcgtgagagatatttggcaagccaaatcgccggaatccagcttaacaaaatcacgccggcaatgataaaaagcagctgcttgaacagggtgaatgccagatcatcacgataagaatcaagggcgtaagacagcatcatcgcatcctggccgttaatggtgaggccttttttaatgacgaaaaaaactttttcaccgctgatgtccgcgctgtatcgtttcgtgacgctgtgctggcggcccgcgagcttgtacaccttatggataaaggaagaagaaaaatagttcaagtctttgtcactggccgattcctcccgctccggcagaagaacgtgctgaacggatcggaaagtcgtcggagcggtcgcatcctcgctgtaatatccccgctcgatcgatccgggcagccggtactccgtcagtacatgctgttcattttcaatggtcgtatacgtttcatccgtgaaaaaattacgcagcgtatttgagaacagcacgagaagcagaatcgagatggctaagaggatgcctgagatgaccacccatatttgaaaagcaagcggcttatttttcatgacgtcatcatcctgtagccgaatccgtaaatggtctcaacctttaacccgggcattttttttctcagcctccgcacaaggtcatcgaccacccggtcagtgccgaaataatcatggccccatattttcagcaggatatcttctctggaaaaggggtgtcctttatggtgaagaaataaaagcagcagatcaaattccttagacgtcaaattgaccaggctgccggtttcatcataaacctcccgggcatcttcgatcacattgtaggaagaaacggtgatgccggttttctttgcggcgggctgttctttatacacgagctcgagcagtttctggacccgtataataagctctctcggcaaaaaaggcttggcgatataatcattgcttccaagctctaacccgaggactctgtcaatatcggcatcccgcgcggaaatgaaaatgaccggcacatcgggatctttttcttttatttcttttatcaatgtatagccgtccgtatccggaagcatgatgtcaagaatccacaagtggggagacggctgcatctgctttctggcatcttcgccttttgtgaaagatgtaatgttccagccttcattctctaaatattttgtgagcagttcattcaggttatcctcatcttcaactagataaatggtgtatgacaaggcatttcacatcctttcaacgtcattatactagttttaacatactcaagccgcattttcataatttcacatattcttttcatttttatcccacaatgtttgtttatgatgtgtataagggaagaaaggaagaaaaaaagcggggaagataacatgttcaaacacattttgttttggagctttgcttttctccttattattgggacaatagaacttgtacatgcgatgaatatgtaatcgatagaatgaaaacatgctgaaggagtgtgcgtgaatatgaacgatcatcgagatgacggcagaagccgcgatcagtcagatctttcacatacggaacaaaacagaaatgaacagcagcagatcagccatcaggagcccgagctgcttgaagggaccgtctcgaaagaaccggaaaacgagacggctgccggtacggaatttgaaaaaacggctgccgtgaaaaaagaaaaaaaacggagagccgcttggctgagcccgattttaggcggcattatcggcggaggcctcgtgcttggcattgtgccgaacctgccgggtgagcagcataagacagaagccgtttctgatacgaaacaagttcagtcttcgaattttacgtcaacgcctttgaaaaatacctcaagcgtagcggatatggtggaagaattggagcccgcgattgtcggagtgtccaactaccaagcttcgcaaagcagccagttcggacttgacggcggttcaagctctgaaacggaaagcggcacggggtcaggcgtcatcttcaaaaaagacggcgaaaaagcgtacatcattacaaacaatcatgtcgtagaaggggcgaacaaactgtcggtcactctttacaatgggaaaaccgaaacggcaaagcttgtcggaaaggatgccatcagtgacttggctgtattggaaatcagctcgtccaatgtcaaaaaagcggccagcttcggggattcctccaagctccgcattgccgataaagtgattgccatcggcaacccgctcggccagcagttttccggcaccgtcacacaaggtgtcatcagcgggctgaacagaacggtggacgccgatacatcccaaggcacggtggaaatgaacgtgattcagacggatgcggcgattaaccccggaaacagcggcggcccgttaatcaactcaagcggccaggtcatcgggatcaacagcatgaaagtcagtgaaaacggcgtggagtcgctcggctttgccattccgagcaatgatgtagaaccgatagtcgaccagctgcttgcaaaaggaaaagtcgagcgcccgtttttaggtgtgcagatgattgacatggcgcaagttccggaaacctatcaggaaaacacgctcggactgttcggcgaccagctgtctaagggtgtttacgtaaaagaagtgcaatccggctcaccggctgcgaaagcgggcatcaaatcaaatgacgtcattgtacaactgaacggcaaagatgtcgacagcagcgccgatatcagacagatcttatataaccagctgaaaatcggcgataaaacgactgttcaagtgctcagaagcggaagcaaaaagacgctgaacgtcacattaacgaaacaaactgaaagcgcaagctgagcgcataaaaaaagctgaaccttcaactgaggttcagcttttttcgtcattctcccaagtaggctgacagcatccacacatgcttgtccgcttcttcaactaatccgacaaacaggtcggcagttgacgggtcattttgttcctctgcgatgccgatgacaaattttgattcgcggctgatttgtttatagtcttgaaccagtgatttcaccatttcagaagccgttttttcctgaccttcatccgtaatggaagcttgttcaaggtaagtgtgcaaagtcgccgcaggctgtccgccgatggccagaagacgctctgcgatggcgtccgccgtttccgctgcttcgttatacagttcttcaaatttttcatgaagcgtaaagaagtgagggccttttacataccaatggaagcggtgcagtttagagtaaaggataaaccagtttgataattgtgtgttcattgatttctcaacaagagtttcagtttttttcgcgttttgtgtattcatattcatcgtcctccctgtgatctgttaatttaattatatcacgtatcaaataaaaatcaatactaaattataattattataatttagtttaagtgaacagctttttctttataatcgattcccaagcggaccacggaaagagtgagcggaaagccaatgtcagcttaacgcccctgccgatcggataccgcagtttcttcagccgtttcctttgtgccaattgataaatcagctccgctacgtcatcaggatcgccgcttttggatgcgttggctttgaagtaagcttcaaggggctgataaaagcgataataaggcgagtctttgccgggcgccgtaatatggctggagagagacgtctcccaaatagacgttttataggagcccggttctattaaagcggcatcaattcctaaaggcagaagctcgaggcgcagacactctgtaaacccttcaaccgcgaacttggaagagacatacggagatagagccgggaaaccggtcagtccgctgatactgctgatattgaagattttcgccccgccatgtttccgcatataaggcagcacggtttttgtgacgtgaatcagaccgaatacatttgtttcatactgctgtctgtaatgttccatcagcacatcttcaataaaccctccgtacgcagtgccggcgttattgacaagcagctcaatcggtccgaaaccgctgatggtgttcccgaagtcagacaccgactgctcatttgtcacatctaaagaaacgaccgtaatatatgcggatgcacccgcttgagcggcggcctctttcagtattacagctttctccggctgtctggctgttgcgatgacgtgataagaccgggcgagcttcagcgctgtcagcatcccgaatccgctcgtcgcaccggttacaatggcaacttttctgttcatcttataatcctccccgtttgtcgtttgttcttatctcatagtgtataacatctcgcggaaagaaggagaaatcgttcggaaatatgtcagaattgttttataatggagtcagcttcggatagaaaggggtaaagaaaagatggcattagagggattgaaggaaacatgggatttaaactccatttttgagggcgggagccggtcggaagagtttcagcaatacatacaagagctcaaaaagcatctaagcgcttttcaacatgcggttgaagcatttacagttccgacgcacgcggatgaaagccgggagctgatcaatctgattgataggtttgaacggtcagcgatcatgatcaggcaggcgggagcgttcgtcggctgtcttcaggctcagaacactcatgatcagaaagcgaatgaatggagagcgcggatcaatcagctgagcagtgattttaaatccgctctggtcacccttgacgatacacttgcccggattgacgagcgggtctgggaggagctcctgcaaaaaccggaacttcaggatctcacatatgttttaaatgagagaagagaccgggtcagagagaagctcagcgcttcagaagaaaggctgattgaaggcctggccgttgacggctatcacgcatggggcgacctgtataatgcggctgtcggcagaatgaagattccgtttgaggataaagagctgtcggtcggccaagcggaaaatatgatggcgcacccggatcgccgcatcagacgtcaagtgttcaaagagcttaatgaagcctggaaaggagaagaggagcttttcagcagcacgctgaaccatctggccggcttccgcacggaaatctataaagcgcggggctggaaaagcgctttggaagagccgcttgcgatcaatcggatgaaaaaagaaacgctggatgtcatgtggcaggtcattaccgatcataaaaagccttttgccgaatacctgaatcgaaaggcgtctcttttagggcttgagcggctgaactggtatgatgtgggcgcgccgatcggcgaggcttcgaaagaatacacatatgatgaagcggctaatctgatcgtcagccaattttcgacgtttggcaaaaagctgtccgcattcacggaaaaagcgttccgcgatcggtggatagaagcggaagaccgcagcggcaaacgggtcggcggtttctgcaccagctttcccgacagcggagaatcccggatttttatgacgttttccggaagcgcttcgaacgtatcgacgctggcgcatgagctcggtcacgcgtttcatcaggaggccatgctccaagtgcggcagctgaacagagcctacgctatgaatgtggctgaaacagcctcgacctttgcggaaatgatcgtcgccgacgccgctttgaaacaagcggagacaaaggatgaaaaggtgttcttgcttgaagataaaattcaaagaagcgtagccatgtttatgaatattcatgcgagatttttatttgaaacgcgtttttatgaagagcgcaagcagggcgtcgttccggctgagaaactgaatgaactgatggaagcggcgcagaaagaagcattttgcgattcattaggggaataccaccctcatttctgggcgtcaaaactgcattttcatattacgggagtgccgttctacaatttcccgtacacgttcggttatttattttcgcttggaatatatgcaagagctcttcgggaaaaagcggattttgaagaaaaatatatcgcgcttttgtgtgacacggcttcgatgaccgttgaggatttggcgatgaagcaccttggagcggatctcacggaacggtcgttttgggaagacgcggtccgccttgccgtacaggatgtgcaggaatttttagagctgactgaatgataatctggagatgaaccggccggagctgttaccgctccggttcttttttgttccgtgaatgacagccgcctcccttggaaatacctaaaaacgatcggaatggaatgggagtgaatcgcatgaaatggatcagaacggcgggcgttttatgtcttacgctgatgctgattgccggctgccgattgaatgaagaaaaacgggaagcggaacaagacagcacacctgtgtcatccgagaagccggttccttacagcagcttttccctgcgcgtcagctacggagccggagagcataaccgctatgaaggtttgtatgaaagaaaaagcggtcatgaaaaggcggacatccgggacaagctctcaggggttcacagagagggcgaggaagcgcttgatgaaatgaagatgatcctcggagaacttgccgtaaacggccggatgcaggaaagcgaggtcgtccgggaggtgctttcggcttttaatttggacagccgctatgaccatttttatctaaaactgaaaaagaacgatggagtaatgacggaaataaaaaaataaccgccgcccgctgcttttttacccaaaactaattgataatgatattcagagtcattaatttctgttacaatataatcatgatctcacgttgaatgtttaggcaatttgtttatatacatagtgttgggaaactcaaaaaaggagcggttagcggtatgagtgcaatttctacagagacgctgagcttagggtacggagagactgttatcattgacgaattggatgtcgcgattccaaaaggcgaaatcactgtattgatcggaagcaacggctgcggaaaatcgacgcttttacgttcattggcccggctgatgaaaccgaggggcggttctgtgcttttagaaggaaaagccatcgctaagcttccgacgaaggaagtggcaagagagctcgctattttgccgcagagtccgtcagctcccgaaggcctgacggtgcatcagcttgtgaagcagggaagatacccttatcaaagctggctgaagcaatggtccaaagaggacgaagacgcagtcacaaaagcgctaaaagcgacgaagcttgaggaaatggccgaccgtcctgtggattccttgtcaggcggacagcgccagcgtgcatggattgcgatgacactcgctcaggatacggatatcattctgcttgacgagccgacgacttatctcgacatgacgcatcaaattgaaattcttgatttgctgtttgaattaaatgaaaaagaaaaacgcacaatcgtcatggtgctgcacgatctcaatctggcatgccgttatgcccattatctggtcgccataaaggataaacagatttacgcagagggccgtcccgaagaagtcatcacttgcgagcttgtacagcaggtctttgcaatgaactgtcaggtaacgcaagatccgctgttcggcacgccgctttgcattccgcacggacgcggcagatgtatcgtgcaggaagcggccctcaccgcccgattgtcataatcatgaaaaagggaaggaaacggtatggaagaaaaactgcagcagcagctggacggcctgcttgagaaatacactgaactattgcttggcgaaacaaacccggatgtaaaggaagaagtcaggcagtggattttgtatacacatatcgcaaaaagcatgccgccgctcgtcaaacattggaatcaatcctacccggacgccaaagagggcatcaaagctgcgatacagcacattaaacagctcaatgaagctcacagaaaaaaacaataaaaagctttcggcatcaaagagaggtgccggaagctttttttgctgaaaaggaatcaataaaggcgccgttcaattcataacgaagaactttaatgtaactaacacacccgtttgtttacttgctgaaccaagaaaaaaggaccgccgcagcaatcccttactctttcctatatatcacatttcctttcggatacgtaataactcttcaaatgcttttatatttgtatcaaaattgggcactgtttgagattcctcggcacatttgacttgtgctacaaccaaatcattaaaaggtgttgaaattccagtaccttctgccattttgggaataactccattaatataatcaatttcagttttgcgttttttctcaagatcctgaagcatacttgctcttaaaagcctggatggttccatggctgccctaaatgtttgaatacgttcaggaatctcattttcactttttaattccaaagattctaaatcaaggccgcccattttcgcaaatgtgacaccattggcgtgtccaaccttaatcgtctcatctgcgatatgaactgcgctgacaatgccgatttcatggtcaagaatatcaccgtattctccgtttaatgctgccgataaaccactgaatgcattattgataagtaattttgaccacttcgttccaactaaattatcggaaatatgtgttccgccgataaggtctaaaaccgatttaatacgctggattctttctgttgtttcaccatttaattctccaatttgaaaagcgtactctttaaattgagtatactcagttgtaagtctggatacgcctggttcaataaacgtagcaccaaattcaacagaacctgcaataacacgttcaccaccaacgatcgaagcaactttctgttcaggtataccgttttgcaaggaacatactacactatcatcctttaaaaaaggcagtaactctttaagaatggagtcattatataattgtttcgtcaggagcaatatgaaatcatacttgcctgacttgttttcaggggtaatggcttttacctttgcctgaaatgccgttgtaccaactactttagcacctatttgatttaaagtatctacatgttctttgtatgaatcaattaattcgacatccattccgccagcagacagatatgctccaactatggttcctaaagaacctgctcctaaaattgcaattctcattgtaaacgtctccttatttttcctctaagtagttataaaccggctgtgctgcatttaaggttaaatccgtaataatatgagatgctgaaacgacttctaatacaggcaaatctgcaagaggcgccagagcatgttcaaataattgaagccgcgccggtccagaccaggcacctttaacttctatattcgttatttgcgtgcgcaccaaatcgcaaacccttaaatcaccattgtaatcagtagcaatcttaaccataaaattaggtcggcaaatttcccttttcgctttttccttgtccatttcgaaatgtttatatcccatagtcgcagctgccacacgaagactgccataatctaatgtgccaacgagagtatcagagtctatatacagcttaggggcgcccaatttctttggatatgcagtaagttcccgtccgcttgcaatagccgggaaattgtctacatacatagagtgtacataatctccttcttcaccattaaagctgacagggatgacttgtcctgcctctgtataggcaccaagtccggaaacatcgggcatccgcatcacttcgaatttcactaaaggttcagtaatttcaagaggttccggcactgccgcacgcaaagctttttcatccgttcggtaaataatatttaaatattcacggttaacaaatttataatttgggataggataagcaggagccgttagcggtgtatttaaattttttgctatatctttcacatcaattttcattgcatgacaccctttccttttctttaactatgctattatcttacatccgcatttacatttaatctaatacataataaggtatatatatatttattgaaataaataagggggatgcagacagatggaattgctgcagctaaaatactttcagacagttgcctatactgagcatatttctaaagcagcagaacaattaaagattgcccagccttctttaagtctcactataaaaagacttgagaatgaactgggaacagctttgtttgagagaaaaggcagaaatattaagctgagttcatcagggaaaattcttttaaaacatgtaaacaggatttttactgagattgaaaatgcacaaacggaaattcaattggaggaacatcaaatgtctgacaccatcagaatatctatttctaatccgagattccttgcaggactgatgagtgaatatatcaaccgctcccctcaatcaaaaattctccaagccatcggagttaaaagcgggatcctaacaagtttaaaaaaaggggacattgatttaggaataacaggtcatcctattcaagatgaagagatagaaagttgtatgctggtaaatgaagatattgttctggctttgccctcaaaccaccgatttacgggtaaaaccgaaatttctttacgtcttgtcgccgatgaaccatttattacccttgctaataatgaagagtatagcggttttacagcctcgctttgtgaaaaagccggtttcaccccaaatattgcatttgaggcggattctcatttactggccgagattataaagctggatcagggggtggcgttgcttcctatttcggtttgcagaacattggggctgaattttataaaagtgactgatcactctgcttcatatccagtcggcttatcttggatgaaacataagctgttatcttcttcggtaagaaattttcgtgactttattttgtcgtactataaagataactatgaaatgtttaaggtttattaaataattttcacccccgatttccaatgaggcggaagactggtcattcggaaacggagaggcccagatgatataaaaaaatcccgcggcatccgcgggatttttctttgttaaacggctttcgccttttcttcttgtttgcctgtctttttgtttgtcagcttaattgatttaacaaacagcgtgaggatcaatccggcagcgataaaggccaggcctgtgaaaaacacgctgtgaagcgaatccatcagtgacgttttcaaaaccggcacgatatgggaagaaaatgcggccgggatctgcttaatcgattcctgactgaacaaggattgaagcagcccttcaggatttttgtcaatcatacctttaaactgggcggcaaaggcacttgcctgtttcgggagtgagtctaagtaaggcaccagtctgtcggttaaaaggcttcctgatctggcattcatgacagcgccgagcaccgtaatgccgaacgttcccccgatcatccggaaaaattggcttgatgaagtcacaacgcccagctcttcttttgaaaacgtttcttgcagagcgagtgtgagaagcggcatgacgagccccattcccagaccgatcactgccatatagcacgtagccgcgagcttgcttgtatccagctgtaaggtcgttaataagaagaagccgacggccatgatcagcatgccgatcatgatttgcggtttaataccgatcttataaaccagctggcctccgataatacttgtgataatcatagataccatcatcggcgtcataatcgtgcctgacgcggtggcgctgactccgataattccctgcataaagaaaggaacgaacgtaacggcgccgaacatgccgatactcatgaaaaacccgatcagattcagtacggtaaacgttctgtttttaaacaggtacatcggcagaatcggttcttttgctttgatttcagcgaaaatgaatccgacaatcccggcaagcgcaagcgcaaagagaccgagaatctgccaagagccccatgcgtaatcttttcctccgaagctgagcgcgagaaggaggctgacgattccgacaatcattgtgaaaatgccggcgatgtcaaagttaatcggcccagtctgttttctgccttgaagtcctcttgcgataaagatcacggctaaaattccgacaggcaggttgatatagaaaacccatttccaatttaatgagtcaacaatccagcccccgatttgcgggccgataacggaagcaaggccgtaaatcgctccgaaaagcccttggaacttggcacgctgtttccctgtgaacaaatccccaatgacgatcatggccatcggcatcatgacaccgccgccgattccctgaagtccgcggaaaataatcagttccgtcatgttgctggccattccgcacagtgcggaagctcccataaaaatcaataaacctgacacatagacgacgcggcgccccaataaatctgcaagtttccccgcaatcggaacgatcgtcgtcgaagttaaaagatatgccgtggtcagccacgtcatcatgcttaatcccccgaggtcacccacgattttaggaatcgccgttcctacgatggtgccgtcaagggctgagaaaaacatggcgatgattaagcccgttattaataatgtgcgttttggatctttcttttcaatgctcatgtttcggcagctcctctttctattcgttttctttttgatcagccgcgtatttctcggcggcttccgctactttgcggatgatgttcacggactgaatcagttcatcgtcagtcagaacggacaggttacgcgccagtatcgctttccgtccttccacaacatcttcgaattttgtttcgccttttttggtgaggctgatgtcgatgacgcgtctgtcctgctggttatgtttgcggacgataagtcctttttgttcgaggcggtcggccatcagcgtaaccgcgctcggctttacctccatgcgttccgcaatttcggaaactttgcagctcccgtgttttttcaggctggctaaaacaaataattgggcaggcgtcacctcgtgttttgccatgctttccaccatttcaggctgtatgttttgcagcagcgtctgaagagatttctggatgtcagacacatattgatccgcgtttttcataactcctcctcatcttgttccttgagaaaataattaacattagttaaatataaataaggattaatgataagtcaatctttttgtgcaaaaataaaaaaaggactgatgcttggcgaaaacatcaaatcctttttcattttactgctggtagggagactgctgctgaatggtctgccggaacttctgatacgattgctgaagcttttgggtatcggcggcttcaatggaataccagccattttgaaacatcacatcgtataatcttctttgcgctttttgtgactcatcgaaaatcgcctgaatatcttgataaagagactcgtggctgaactcgtgcagggctgtgcaatatgaagccgtgatgtatttttccgtcgtcagcagctcattgaccaagtctctgtcattcatttgcgccgtattgggcacgggcgtttgcggattcgtgattttttgattttgctgttccatgtattgtcctcctattgcatatagcctgttgttgtctgtccgccttgaccggggttcaagcggcccaatatgtgctgataatgcttctcatgcatccggccgatctgatcaagctcttgttttaacgtctgattctggcagtgttccgccataaaatgcgcttttttcatggcaagcagattccagttcagcatgtcctcaagatacaaatggtctttcgttgagatgacggcaggcggcaagtttccgtgctgctcttggttgttcatataaacgcctccttcaattctgttctttttagctttctctgcgatcgggatttcatacagataaattaaaataaccacgatttgcaggagagacatcaatatttacaataaaaaaagacactatcagaagaaaaaaccttcggataatgtctgttcatgttaacagttcgatatatgcgaaagtcagcagcggcactaggattggacttcagctgccggtttattgtctagatcagtgccggcttttctttcagttatttttatttttggtaaaagaaaagcagaaaatactccggcaattaatagtataagccctgcgaaaaatacactgcgaagagagtccattaacgctgtcttcattatcggtatgatgtgctttgctatagaatgcggaaattgttcgaatgaaccagaactgaatagcctctgtagcaggacttgaggattgctgctgatcaagtctttgagatgagctgctaatgcgttttcttgttttggaaaattgtctaaaaaaggaactaatttatcggttaatatatttcctgacttggcattcatcactgctcccagaatcgtaattccaaacgtacctccgatagagcggaaaaattggcttgacgaagtaaccacgccgagcgtttctttagagaaactctcttgaagtgccagagtaataatgggcataacaaggcccataccgaagccgatgatagctacataagtagttgcagttaatttgctggtgtcagcttctaatgtggataataaaaaataggcaaaggatatgattgccatccccgtgataatctgcgctttaatgccgattttaaagaccagctgcccgcctataatactggagataatcattgcgaccatcatcggcatcatgattgtcccggactctgatgcactcatgccgattattccttgcatgaagaaagggacgaaggtgattgctgcaaacatcccaatactcataaagaaccctattaaatttaagaagataaaagttctgctttttagaagatgtataggcagaattggttctgcagcttttttttctgcaaatacaaaactaataatacttatagtggccaaagctaacagacaaaatgtctgccatgataaccagtcaaattcttttccgccgaaactgagtgtaagcagcaaacagactacacccgtaatcattgtaaacatcccgatgaagtcaaaatgaatcggacccgtgtattttctggcctgcaatcccatcgcaataaagaacacagctaccattcccacgggtaaattgataaaaaatacccaatgccagctgaaagaatctacaatccatcccccaatttgcggaccgattacagaagcaagagcgtaaataccgccaaatacgccttgaaatctggcacgctgtttgcctgtgaataaatctccaatgacaatcatagccatcggcatcataatgcctccgccaagaccttgtaaacctcgaaacacaattaattctttcatgttatcagccaggccgcacagtgaagagccaatcatgaatataatcagcccggccacatatactgcccggcgccctaatagatctgcaagttttccagcgatcggaacgatggaggtagatgttaataggtaggccgtagtcagccaagtcatcatgctcaggccgccgagatctcctacaatcttaggcataaccgttcctacgattgttccgtccagagcagaaaaaaacatagctataataagtccaattaataaaagtgtacgtttagattttcctgttgaatccaattgaaggttccctcttttcatatgtttcgagcttagtgattcttcaaaataaggtgaatggataactcaggcaggtcccttctttaaattccgttagggaagagaagccatctttaaagatgaaggatcgtaaagctattagaaagaaataataatgctttggaggtatgtttgtgaggcaaagataaattcagcagaattatcattttgaaattctgcttttccttcttaatagatacgttcaataaactgaattatcaattttaaatataagccattgtaaattataaatcaattatcttttaaggaatattttcaaattataaggggataaagaaatataaattataagtttttttgggcgaaatgtaacgaagaagcggaattatagctcgaaaactcaattgaagaagtagtgatttttattgatcctttttgtgactcattaaaaccgtttgaatatcttgataatataatacattgctttgacatcagagtctgtatggatatatgaatgatatcttggcaatctgcatggcttttgtgttttagctttctctgcgatcggaaattcatacacgaataaaagaaaaaggagggagttcatccttgctgcggagcatatgtttatttttgtcgaaaaataaaatgcttacaaaattcgcccaggcttacggaatccgcttcggcgcgggaaggttcgttgcaggggaaacgctcacggaagctgtgaaaacggtaaagcggctgaaccaaaaagggctgtcggcttcgattgattatctaggtgaatatgcgggttcagagaaggatgcgaaaaagacggcggaagaatgtaaaaaagcaatcagggcgattgccgagaatcaactggattgtgagctgtcgctgaaattaacatccatcggtctggatatttccgaggaactcgcggaacagcatgtcagagacatattgacggaggcaaaagaacgcggcgtgcctgtaacgattgatatggaggactattcaagatgcggccgtacgcttgagctgtataagcggtgcaagccggattttccgatgctcggcaccgtcattcaggcttatttataccgcgcagctgaagacatcagcggtctgatgccatataagccgcggctcaggcttgtaaaaggcgcttataaagaatcggcggccgttgcgttccctgataaaaaagcaaccgatcttcattttcagcagctgattaagctgcagcttttgagcggctatgaaacggcggtggcgacacatgatgacgatattatttcgtatacgaaaacactcatcagcgagcatcagattccccgggagcagtttgaattccaaatgctgtacggcatcagaacggagcgccagaaggagcttgccgaagaaggatacaggatgagggtgtatgtcccgtacggaaccgattggtacgggtacctgatgagaagaattgccgagcgcccggcaaatgcggcgtttgtgctgaaaggaatcttcaaaaaataacggctgctccaaaaagcagccgcagtatgttattccatgttgtcttttttatattgctgattttggctcgtccgtttgccgccgccgtatttttgcttcggtcccgcatttcctttcatgctggccgcgctcactgcggcagaagacggatcttttctccctcgcaccattcccttcacctccgggtttaagtttcccgcccgcgccatggaacatgcggaagccgaaaaatttaaaaaaattccatatttgctattgaagtcatcctgaaaatcttttaagatgaaagaagaaaagggtttcattttttttgccgaaaaaatgaatgactattcattcaaagttcaagggggatgactcatgcacaagtttataaagaaagcagccgttctcggatcaggcgtcatggggtccggaattgccgcgcacttggctaacatcggaattcccgtcctgctgcttgatattgtgccaaacgagctgacaaaggatgagatgaaaaaagggctgacattagaaagcccggaggtccgcagcagactgagccgatcggccatgcaaaagctgctgaagcaaaaaccggcgccgctgacttcggctgccaatctcgactatataacggcggggaatttggaagatgacgcagctcaattgaaggatgctgattggattattgaagtcgtcgtcgaaaaccttgacgtaaaaaaacagattttctcactcgttgatgaataccggaaaccgggaagcatcgtgtcgagcaatacgtccggtatctccgtcacaaaaatggcggaaggccgatctgccgattttaaggctcatttcttaggaacccatttctttaatccggcccgctacttgaagcttctggaaatcattccgattcaggaaacagatcctgacgtgctggagtttatgacttcatttgcagaaaacacgcttgggaaaggtgtcgtcatcgcaaaagacacgccaaactttatcgccaaccgcatcggtacgtacggcctgctggtcacggtaagagaaatgctttcttccggctgccgcatcggcgaggtggacacggtgaccggacctttgatcggcagaccgaaaagcgcgaccttcagaacccttgacgttgtggggcttgatactttcgctcatgtggcaaaaaacgtatatgataaagccgacggcgctgaaaaagacatgtttaagcttcctgaatttatgaatgacatgctgaaaaacaattggctgggcagcaaatcaggccaaggtttttacaaaaaagaaggtaaaacaatatatgaactcgatccgctgaccatgacatacggtgagcgctcgaaaatgaagacgcccgctttagaagccgccaaacaggcaaagggtgccaaaggcaaaatgaaagcgcttgtatattccgatgaccgcgccggacgcctgctttggaatatcacatcgcaaacactcttatactcagcccggcttttaggtgagatcgctgatgatataaaagcaattgatgacgccatgaaatggggcttcggatgggagctcggaccgtttgagatgtgggatgccatcggcgtcagaaaatcagcggagcggctcgaagaagaaggcgcagcactccccggctgggtgaaagaaatgcttgatcagggtcatgaaacattttatatgaaggaaaacggaacacaattttattattcagacggccaatacagggctgtgaaagaaaatccgaaacggatcagcctgcagacgttaaaagaaacaaaaggcgttatcactaaaaacagcggcgcaagtctggttgatctcggcgatgatgtcgcgctgctggaatttcatacgaaaagcaacgcgatcggcttagacattattcagatgattgacaatgcgcttgaggaaacggagcggaattataaaggtcttgtcatcggaaaccaaggcagacatttctgcgcgggagcaaaccttgcgatgattttaatggaagcccaggatgataacttcatggaagtcgattttgtcatccgccgttttcagcagacgatgctgaacatcaaatacagcgctaaaccggttgtagcggcgccattcgggatgacactcggcggcggcacggaagtctgtctcccggcggcacgcgttcaggcggcgagcgaatcgtatatgggtctcgttgaaaccggcgtcggtcttattccgggcggcggaggaaacaaagagctgtacatgaattatctggacggcggaagtgaactcatggacgcagcgattaaaaccttcgaaacaatcgcgcttgccaaggtgtccggttcggcacacgaagcccgtgacatgaagattttgtccgcggcagaccgtatcagcatgaatcaggatcacctgctgcacgatgcgaaacagctggctgcttccttatatgacagcggataccgtccgcctgcccgcaaaaaagtgaaagtcaccggagaaaccggctgtgcggcattactgctcggagcagaccaaatgagacggtcgggttatttatccgatcacgatatgaagattgcgaagaagctggcccatgtcattgccggcggaagagtcccgttcggcacggaggtttcagaagaatatttactcgagattgaaagagaagcctttttaagcctcgctggcgaggcgaaatctcaagcgagaatgcagcatatgctcgtcaaaggcaaacctttacggaactaggagggtgtttatgagagaagcagtcattgtggccggtgcgagaaccccggtcggtaaagcgaaaaaaggatcgcttgcagccgttcgtcctgatgatttaggcgcgctttgtgtaaaagaaacgctgaaacgggcaggcggctatgaaggaaatatcgatgacttaattatcggatgtgcaacacctgaagccgaacaaggattaaatatggctcggaatatcggtgcgctggcggggcttcctcatacggtgccggccattacggtgaaccgctactgctcttccgggctccaatccatcgcttacggtgctgaaaaaattatgatcggcgcgggtgataccgtcattgcgggcggtgcggaatccatgtcgcaagttccgatgatggggcatgtgacacggccgaatatcgctttggcggagcatgcgcctgagtattacatgagcatggggcatacggcggagcaggtcgccgaaacgtacggagtatccagagaagaccaggatgcatttgcagtccgcagccatcagaatgccgcaaaagcccttaaggaagggaaattcaatgacgaaatcgtgccggttgaagtatcgctgacagaagtcggtgatgaccataagccgcggaaaaaacaatttaccttttctcaggatgaaggcgttcgtcccggcacgtcggctgacgtcttggcgaagctccgcccggctttttcaaaaacgggaaccgtgacggccgggaactcttcacaaacaagtgacggcgcggcggctgtcatgctgatggatcgcgaaaaagcatcgtcgcttggattggccccgcttgtcaaattccgttcctttgccgtaggcggcgttccgcctgaagtaatggggatcggtccgattgaagccattccgcgggcgctcaagcttgccggactcgaattacaggatatcgggctttttgaattgaatgaggcctttgcttcacaggccattcaagtgatcagatcgctcgggatagatgaagaaaaggtgaacgtcaacggaggcgccatcgcgctcggacatccgctcggctgcacggggacgaagctgaccctgtcactcattcatgaaatgaaacggagaaacgagcaattcggcgttgtgacgatgtgcatcggaggcggcatgggcgctgccggcgtatttgaactcatttaaaaaaagggggaaatgaacatgaaacaggaaacggtcaacgtcaaaaaaggcggcagctttctgattgaagagacgggatatgatcaaatattcactccggaggactttacagacgaacataaaatgatcggcaaaacgacagaagactatgtcgtaaacgatgtgcttccttatatcgatgaaattgaaaaccatcagtttgagcattcggtcagactgctgagaaaagccggagatctcggcctcctcggagcagacgtgcctgaagagtacggcggaatcggcctggataaaatcagttcagccttcattacggaaaagttttcacgtgccggcagcttttcgctatcttacggcgctcacgtcgggatcggttcattgccgatcgtgttcttcggaacggaagaacagaaaaaaacctatttgccggacttggcttcaggacaaagaatcgcggcatacgccttaactgagcccggttcaggttcagatgccctcggcgcgaaaacgacggctgttttgaatgaagcgggcacacactatattcttaacggagaaaagcaatggattacaaactccgcctttgcagatgtctttgtcgtctacgctaaagtggacggagataagttttccgcatttatcgtagaaaagaactatccgggcgtatcaacgggaccggaagagaaaaaaatggggattaagggttcatcgacaagaacgctgattttagatcaggcggaagtcccgaaagaaaatcttctcggcgaaatcggaaaaggccatgtcatcgcctttaatatcctgaatatcgggcgctacaagcttgccgtcggcacaatcggcgcttcaaaacgggtgattgagctgtctgccgcttatgcaaaccagcgccggcaatttaaaacgccgatctcaagcttcacgctcactcaggaaaagcttgcgacgatgtcagcgcggctttacgccatggagagctctgtatacagaacagtgggcttattcgaagataatatgagcagactgacggaagaggagcaaaaagacggacgcgaagtcgcgaagtccatcgccgagtacgcgattgaatgctcgctcaacaaaatgtgcggttctgaaacgcttgattacattgccgacgaaggggttcaaattcacggcggttacggatttatgcaggaatatgaagtggagcgcgcctatcgcgactcaagaatcaacaggatttttgaaggcacaaatgaaatcaaccgcctgatcgtaacgagcacgtttctgaaaaaagccgtaaaaggtcagctgccgctctttgaaaaagcaaaagcgctccaagaagaactcatgatgctgatgcctgaagagccgggctcagaacctcttgaacaggaaaaatacattgtcagacaggcgaaaaagatcgccctcttgacagcgggtctcgcggcgcagaaatacggcaaagagattgaaggcgagcaggaaatcatggtgaacattgccgatattgtcagcgcgctgtatgctttggaatctgccgtcctcagaacggaaaaagcaattgcggcggacggtgccgaaaaagccgcgcagaagctgttatatacggaaatctttgcccaggaagcccttcagaacattgaagcgcacgccaaagaatcactgatcgccatggaggaaggagattccctccgcatgatgctttccgtgctgcgcaaactgacgcgcctgacgccgaaaaacctcattcagaaaaaacgtgaagcggcagcagccgtcttccgtgaagaaaaatatacagtctgatcacatgctgaaagcgctccttcatcaggggcgctttttcatgaagcaacgttataggtttttacaagtgattgtgttaaaataacgacgatcatttacaaggggtgaagaagatgtcgttaaatttttactggtaccctaaatgcggaacgtgccgtaatgcgaaaaaatggctggaagaccgcggtaaggaaataaacgaaatacatatcgcggaggaaactccgtcgaaagaagaaattaaagacctctatgaaaagagcggtcttgagctcaaaaagtttttcaacacgagcggaatgaaataccgcgagctgaacttaaaggaaaaactgtaccatatgtcagaggatgaacagctcgaacttctggcatcagacggtatgctcctgaaacgcccgattacgacagacggcgaaaaagtcactgtcggctttaaagaagaccaattcgaaaaatattggatgtaatgccaggttcaaagaattatggtatcttcttattataagaaaaaaatggagggatttagatgagcacaccgaaagatatgcgttattccaaagagcacgaatgggtcaaagttgaggacggaaaagcccgtatcgggattacacatttcgcgcaagccgaacttggcgacatcgtatttgtcgagcttccggaagtcggcgccgaaattaaagcggacgagccattcggcagcgtggaatccgtcaaaaccgtatccgaactgtacgcaccgattaacggaacggtgacggaagtgaacgaagaccttgatgacagtcctgaattcgtaaacgagtctccgtatgaaaaagcgtggatgatcgtcgtggaaccggctgatgctgaagaaatcgaaaacctcatgacttctgagcaatatgacgaaatgacacaggaagactgatcggatagcaaaggggccatttggacactctatctgtaacgggaggtgtctaaaatggcttttgataaacaaaaggtcgatgtgacggagaacgtcacgggccgctttcaaaacggccggttttccttgtttcatgaaaatgaagccatcggcgagatgacaggcatggaccagtacgagctcaaacagggcttttcatttgaaaatcaaaaattttataaaacagccgatgtcataaacggcagcgatccgaaatatgtcgattgcgattatgagaatggctggtgttaacagttggcggtgaatttcactgccttctttttcaatctgacgctaaaacaatcggcaggtgacgcgcttatgtacaacggagatgaaaaggtcattatcgtagaaggaaaatctgataaaatcaaagtcagggaagtgctcatcgaacccgcggaaatcgtctgtacaaacgggacgatcggccaaaccgaactggaagagttggcggaccgcctgtttgacagagacgtctatattttaacggacgcagatgactccggagaaaaattaagaaaacagctgaaacgggagcttcccgaagcgcgccatatttatatagacagaacatacaggcaagtcgagtcgtgcccgggccatcatctcgcatctgtgctgatcagagccggctttgatgctgacactgtatttttgaaaaagaacgacctgaggtggtaatcatgaaagaactccaagaaaatgaactcgaatcgattcaggatgacgtttatctcctgtatttgtacaccccgttttgcggcacatgccagctggcgtccaaaatgcttactgtcgtcgaagaaatgctgcccggtgccgccttctataaaaacaacgtgaattattcccccgcattcgccaaagcctatcagattgaaagcgttccgtgctttttgctgtttaaaggcggagagcttgttgagaaaggatacgccttccgctccgtttcctatttatatgagctgattaaacaaaaaacatcgcaaacgttcccgatgtgacaatatttacaggaaaatgtcgtgcggtttataaagggttctgtccgttaaaaagagaaagtgtatgtatggccattaaaacgggaggttatacgagtggagaaaatagaagtttcagagaatgacggacagcatctgtttttgaaaccgctattaaacgcctcaacgctgctgattacattccaaggagaaacagaagccttaacggtctcaattaacggacagggagaaatgagaaaaacgtcggcttcaaaggagaaatctaatttgaccttttacggaaaccagacggaaatcatccatctcctgcatggtgatgtctctttgcaaaagcttatccaaagcggaaaactcaaagtgaaaggatcattcagagccctgctgaagctggaggccatcctctggctgacaaacggattttttcaggcgatcagtaaacggccgtaactgccaatctactatgtgacaatagcttccaatatttattttattgactttttatcattcgccgtgctattctacagtaagaatttccggacgaaaatacgatatgttttctcttatcaagagaggtggagggaagtgccctatgaagcccggcaaccatcaacaatgttgaaatggtgccaattcactcaaagcggtctgctttgaaagatgagagaaaggcctttttcaataagcctttctgctcatttttgcagaaaggcttttcttttgcggagaaacccggaagatttcttagaatagtgtaaggcgggtgattgctttgatccatcttcaaaatgtttcaaaaatttacaaagcgaagcatggggatgtcaatgctgtccaagatgtcactcttgatatcaaaaagggcgaaatatttggaattataggatatagcggagctggtaaaagttccttaatccgtctcctgaacggccttgaaaagccgacgtcgggaaccgtggaagtcgcggggacggaattaaataaagtaagcagccgcgggctgagaaaagcgcgccaggaaatcagcatgatcttccagcattttaaccttttgtggtcgcgcaccgtccgggagaacattatgttcccgctggaaatcgccggcgtgaaaaaaagcgaacgggtccgccgcgctgatgaattgattaaactggtcggattagaggggaaagaaaaatcttatccgtcgcagctgagcggcggtcaaaagcagcgtgtcggcatcgcccgggcgctcgccaataatccgaaagtccttctgtgcgatgaagcgacatcagcgctcgatccgcagacgaccgattcaattttggatcttttatccgatataaatgacagactcggtctgacgatcgtgctcattacccatgaaatgcacgtcatccgaaaaatctgcaacagagtcgccgtcatggaaaacgggaaagtcgttgaagaaggcgaagtactccaagttttcagaaacccgcgcgaaccgatgaccaagcgtttcgttcagcaggtgacagaaccggaggagacgaaagaaaccatccagcattttctgcaggaaacagcgacagggaaaacgattcagctttcatttgtcgggcaggccgccgagcagcccctcattacggaaatgatccgaaactttgatgtggacgtcaatattctgcaggggaaaatttcacagacgaaggacggagcttacggttcattattcattcatattgacggtcaggaaaaagaagtagaaaacgtgatccggttcatcaaagacaaacaggtagaagcagaggtgatcacaaatgtttgaaaaatggttcccgaacgttgatataaccgagctgtggacggccacatatgagaccctttatatgacggtcatcgctttagttttttcatttatcatcggagcgattctcggtcttctgctctttttaacgggcaagggaagcttatgggaaaataaaatcattaacaccgtgattgcggcggtcgttaatattttcaggtctattccgtttcttattttaattattctgcttctcggctttactaagattctggtcggatcgattttaggaccgaatgccgcattgccggcgctgattatcggctccgcgccgttttacgcccgtcttgcggaaattgcgctccgggaagtcgataaaggagtcatcgaagctgccagatcaatgggagcaaagacatcgacgattatcttcaaagtgctgattcctgaatcaatgcctgcgttaatttcaggcatcaccgtgacggccatcgccctgatcggatctaccgccattgccggcgccatcggttcaggcggactcggaaaccttgcatatgtagaaggctaccagtccaataatacggatgtaacgtttgtagcgacagtatttatactcatcatcgtctttatcattcagattatcggtgatgtaattacaaatataatagacaaaagataagggaggatttacattgaaaaagattgtattaagtgcgctgctgcttgtgttcgcgggagttttagccgcctgcggatcaaacggctcgaataaaaaggaaatcgttgtcgccgcgacaaaaacaccgcatgctgaaatcttaaaagaagcggaaccgctcttgaaggaaaaaggctacacattaaaagtaaaagtgctgaacgattacaaaatgtacaacaaagcgttagctgataatgaagtggatgcgaactacttccagcacgttccttaccttgaacaggaaatgaaagaaaataaagattacaaactcgtgaatgccggagccgttcaccttgagccgttcggagtttacacgaaaaaatacaaatcactgaaagacctgcctaaaggcgcgaccatcatcatgactaacaatgtcgctgaacaaggccgtatgctggcgatgcttgaaaaagccggactgatcacacttgatccgaaggtaaaaacgattgaagcgactacgaaaaacattacgaaaaacccgaaaaacctgacattcaaaaaaatcgcccctgaattaacggcgaaagcatataatgaagaagaaggcgatgcagtcttcattaacgtcaactatgcgattcaaaacaaactgaatccgttaaaagatgcgattcaagtggaatcaacgaaaaacaacccgtacgcaaacatcatcgccgtacgcaaaggtgacgaaaaatcagagaaaatcaaagcgcttatggaagtccttcactctaagaaaatcaaagactttattgagaaaaaatacgacggagccgtgcttcccgtatctgaataaagcgaaaaccccggatgaatcatccggggtttttttcgggtattaatcggagaactgtccataataaaaaggaaggttaacgattggagggaatggcagtggctcaataccaggataacggaaaaagcgtgcatgacgcattgaaacaatataaagaaggtttaggcatattcgagcaaaaaatgcccatgatggggcggaagtttaatgaatttactgagcagtgtttctcagcggattcattaactgaaaaagagaaacaattaatcgctctgggcatcagcatcagcgctcaagatgaattttgcatgatttatcatacgaagggctgccttgaccaaggggccacagaagaaaacatccttgaggtcatcagcgtcgcggcggcattcgggggcggcgcggctctcagtcagggagtgaccctcgtgcagcagtgtattcaggaattcggacatacgacgcattagaatgagcaatcgtgtgaataccgtttttcagataaagcgagcgccggtttccggcacattcgaaaggattcaggggcacaccctctttggccggagcagcggatcattgttacaatagaaacaaatatatgaagggattgattcattatctgcaccagccacgagagactggaccttgactatacgcctgaaatggaaaaagcgatgcagaagtcacacggcatcggctacgaggaatacggacggcgtctttcaaaaaggatggaagtcgaacggcagagggagcttgaatatcaaaaaagcaagttcctcgcagcgcagcttaatgagaaaatcggtcagtaaaaaagggtggatttccgccctttttctgtttcaaacagctttaattacgccttgatctttgataaactttaggaatgttccgggtaatataaaaagttgtatttacttttcatttgttataaaattagaatgagaataaattgagaataatgattatatattttggaggtatagatatggctgcttcaacattaacgatcaaggatcttcacgttgaaatcgaaggaaaagagatcttaaaaggtgtaaaccttgaaataaaaggcggcgaattccacgctgtcatggggccgaacggtaccggtaaatccacgctctcagcagcgattatgggacacccgaaatacgaagttacaaaaggaagcatcacgcttgacggcaaagatgtactggaaatggaagtggacgagcgcgctcaggcgggtcttttccttgcgatgcagtacccaagcgaaatcagcggtgtgacaaatgccgatttccttcgctctgcgattaacgcacgccgtgaagaaggcgatgaaatttctcttatgaaattcatccgcaaaatggacgaaaacatggagttccttgaaatggaccctgaaatggcgcagcgttacctgaacgaaggtttctcaggcggggagaaaaaacgcaacgaaatccttcagcttatgatgatcgagccgaaaatcgccattcttgacgagatcgattcaggtcttgatatcgatgcgcttaaagtcgtttctaaaggaatcaacaaaatgcgcagcgaaaacttcggctgcttaatgatcactcactaccagcgccttctgaactacatcacgcctgatgtcgttcacgttatgatgcaaggacgcgtagtgaaatccggcggcgcggagcttgcacagcgccttgaagcggaaggttatgactggattaaacaggaactaggcattgaagacgaaactgtaggccaagaagcgtaagcgttagggggataatcatgacattggaaacgaaactatccgtagatcaggaatatgtcaaaggcttttccgaaaagcatcaagaacctgcctggctgaaaaacctgcgcttacaggctcttgaaaaagctgaagatctgccgctgcctaagcctgataaaacaaaaatcacaaattggaactttacaaagttcaacaagcatacagtagaaaacgcgccgcttgcttctttagaagatttagctgatgaagcaaaagcgctgatcgatatcgaaaacgaagataaaacgttatatgtgcagcgtgatcaaacgcctgctttcctttctctttcaaaagaactgaaagacaaaggcgttattttcacggacatcttaacggctgcccgtgagcacagcgacctcgttgagaaatacttcatgaaagacggcgtaaaggtcgacgagcataaactgactgcgcttcatgcggcattaatgaacggcggggcattcctttatgttcctaaaaacgttcaggtggagacgcctgttcaggccgtttacgttcatgaaagcaatgacacggcattgttcaaccacgtgctgatcgtcgctgaagaccacagctccgtcacttacgttgagaactacatcagcacggtgaatccgaaagaagcggtattcaacattatcagtgaagtggtcacaggtgataatgccagcgtgacgtacggcgccgttgacaacctgtcagcaggtgtcacaacatacgtcaaccgccgcggagccgcgcgcggacgagacagcaaaatcgagtgggcgctcggactgatgaacgacggcgacacgatttctgaaaacacgacaaacctctacggagacggcacatacggcgatacgaaaaccgtagttgtcggaagaggagaacagacggaaaactttacgacgcagatcatccacttcggtaaggcttctgaaggctatatcctgaagcacggagtcatgaaagatgccgcatcttccatctttaacggaatcggcaaaatcgagcacggcgcgtctaaagcaaacgctgaacaggaatcccgcgtcctgatgctgagtgaaaaagcacgcggagatgcaaacccgattctcttaattgatgaagacgatgtaactgcaggacatgcggcatctgtcggccgtgtggatccgatccagctttactacttaatgagccgcggaattccgaaagaagaagcggagcgcttagtcatttacggattccttgctccggtggtaaaagagcttccgattgaaggagttaagaaacagctcgtctccgtcatcgaaaggaaagtaaaataatgaatatcaccgatattcgtgaacagttcccgatccttcatcagcaagtgaacggacatgacctcgtgtaccttgacagcgcggcgacttcccagaagccgcgtgctgtcattgaagcagtggatcagtattacagcaaatacaattccaatgtccacagaggcgttcatactcttggcacgagagcgacagacggctatgaaggtgcgcgtgaaaaagtccgtaagtttatcaatgcgaagtcaatggctgaggtcattttcacaaaaggcacgacaacttcactgaatatggtggcgctgagctatgcccgcgccagcttaaaacccggtgatgaagtggtcatcacccaaatggagcatcatgcgaatatcattccgtggcagcaggcagtaaaagcaaccggcgcgactttaaaatatatcccgatgcaggaagacggcacgctttcgctggacgacgtccggcagactgtcacaagccatacgaagatcgtggcagtcgctcatgtgtcaaacgtgctcggcacgattaacccgattaaagagatcgccaaaatcgctcatgacaatggcgctgtcatcgtggtggacggggcgcagagcacaccgcacatgaaaattgacgttcaggacctggattgcgacttcttcgcgctttcttcccataaaatgtgcggcccgacgggaatcggcgtgctgtacggcaagaaagaactgcttgagaatatggaaccggccgaatttggcggcgaaatgatcgactttgtagggctttatgaatcaacttggaaagagcttccgtggaaatttgaagcaggcacgccgattatcgcaggcgcgatcggattgggagccgcgattgattttcttgaagagatcggactcgacgagatttcccggcatgagcataagcttgcagcctatgcgcttgaccgtttcgagcagctggacggcgtgacggtatacggtccgaaagagcgggcgggacttgtgacatttaatcttgatgaggttcaccctcatgatgtcgcgactgtcctcgatgctgagggcattgcggtcagagccggccatcattgcgcccagccgctcatgaaatggctggatgtatctgctactgcgagagcgagtttttatctgtataatacagaggaagagatcgataagctcgcggaagccctccaaaagacaaaggagtactttacaaatgtcttttaatgcaaatttagatacattatacagacaagtgatcatggatcattacaaaaatccgcgcaacaaaggggttttggatgacagcatcgtcgtcgatatgaacaacccgacttgcggcgaccggatcagactgacaatgaagcttgacggcgataccgttcaggaagcgaagtttgaaggggaaggctgttccatctccatggcttcagcttccatgatgacgcaggccattaaaggaaaagatattgataccgccctttccatgtctaagattttctcagacatgatgcaagggaaagagtatgacgactcaatagatctcggggatattgaagcccttcaaggcgtttcgaaattcccggcccggattaaatgtgccaccctttcatggaaagcacttgaaaaaggagtcgctggcgaaaaaggcggcaattaaaagattggagtgaaaatggatggctaaaaaaatgcctgaaattggtgaatacaagtacggttttcacgataaggacgtttccattttccgttcagagcgcggattgacaaaagaaatcgtagaagaaatttcacgcatgaaagaagagcctcaatggatgcttgatttccgcctgaaatctcttgagcatttctacaacatgccgatgccgcagtggggcggggatttaaactctttaaactttgacgaaattacgtattacgtaaagccgtctgagcgttcagagcgttcttgggatgaagtgcctgaggaaattaaacagacatttgacaaactcggtattcctgaagctgagcaaaaataccttgccggtgtttctgcacagtacgaatccgaagttgtgtaccacaatatgaaagaagatcttgaagcgcaaggcattgtcttcaaagacacagacagcgcgctgaaagaaaatgaagacattttccgcgagcactgggcgaaagtcattccgccgactgataacaagtttgcggcgctgaactcagctgtttggtccggcggatctttcatctacgtgcctaaaggcgtgaaggttgaaacaccgcttcaagcttacttccgcatcaactctgaaaacatgggtcagttcgaacgtacgctgatcatcgttgacgaagaagcaagcgttcattacgtagagggctgtacggctcctgtgtacacaacaaactcgcttcacagcgcggttgttgaaatcatcgtcaaaaaaggcggctactgccgttatacaacaattcaaaactgggcgaacaacgtttacaacttagtaacgaaacgtacggtttgtgaagaaaacgcgacgatggaatgggttgacggaaacatcggttctaaattaacgatgaaatatccggctgtcattctgaaaggtgaaggcgcgcgcggcatgacgctctctatcgctcttgcgggcaaaggacagcatcaggacgcaggtgcgaaaatgattcaccttgcaccgaatacgtcatccacaatcgtatcaaaatcgatttcgaaacagggcggaaaagtaacataccgcggtatcgtccacttcggacggaaagcggacggcgcccgttcaaacatcgagtgtgatacgctcattatggataataaatcaacttctgatacaatcccttacaatgaaatcctgaacgacaacatttcattggagcacgaagcgaaagtatcaaaagtttctgaagaacagcttttctacttgatgagccgcggtatttctgaagaagaagcaacagaaatgatcgttatgggcttcatcgagccattcacaaaagaacttccgatggaatacgcagttgaaatgaaccgtttgatcaagttcgaaatggaaggctccatcggttaatagtaaaaccccgccatatggcggggtttttttgtttattgaatagtgaaatttccgtattcgcttgaccggacatgaatcggcccgtttaaattgtagttcttctctttgacaatatcgcggaaaacgtcgacacgggcaaccgattctctccattcatcctgggtgtcctcatctgccggattcatcagatcgtcatagcgtacatccaagaatttattgagccatttcttctcgtccgttccgtctttcggtgacccgcccatttttttgttcgtgcgtttaatcagggcataaaaggagtctggatcatcaccgtcaccatgctgaatcaccgtatcgtacatcaccgctttggccaaggccgttttcagtccggcattttctgaacgtttcatcgccggctgataatacaagctgtcgtttaccttatcctgggcagcgcggaaggctttatcattgccaagtgagcgccaggcagaagcgaatcctttcagattgctgatgtcatcgctttcgtccttcgcaagacgacgcaattcaggcaaatactttttcaatttgttattcggcaccgctttcgtatatacttcgactacttccagcgcatctccggtagccgtcgtaaagccggcccgcccgcaagtgtaacctcttccgtcatccaacgcttcaacatatccgtattggatttccgtctttccgttttcaaaaatgctggtcagctgttccgcacggcgcttctgatccttattcagcccggccgcaaaaaccgtaccgctcatcatcagggtaaaaaacatggtgaaaataagagatgaaaccgccgtcttcttccaaaaacctgcttttttcttcaaattgattttcattgccatacccctttcatatgtaagttacgcactcagtatacatgagggggtgatttttttgttgaaaacacacgaatttgtcaatattttgaatcctaagccctatccagcgcttcataaaaagaacgcaccaccttcaccagacagacaatcccgttctcgcatcattcttatctgtaacatagtcaacgcggtgaaacccgcattgtacagcctgctgaaaaagggcttcgagcatgtccggatctttgcaatataacgttacatacgagcaatctgcgatgagaagcacaagttcacaggaactatccaaatattctcatacgtattgatttccgttaccatcccgctcgggaaagctttcaattcagcacacaacatttcaggcagaaaagagagggaacgggcgatcacggaaatggtgagggtgctgaagcctggcggcacattggccgtgtcagatataaaaaatacatcacaatacagagcaattcttgaggaaaacggctttcagacaagaacgtattccttttattatacgtttccgttttcgaaacttatcattgccgtcaggactccggtaggaaccgggcgctctatttgttaaaataaataagacaaaacagatagaaaaggtgttacacatgaagtcttatatgattatcggagccggcattctcggtgcgtccgcggcttatcatctcgcaaaggccggtgcggatgtaacggtctttgacaggaaacacccggggcaggcgactgacgccgctgcagggatcgtctgcccgtggctgtcgcagcgccgcaaccaggcatggtatgcgatcgcaaaaggcggagcccgctattataaccaattgatacagcagcttgaagctgacggagaaacggacaccggctatcaaaaggtcggtgccgtcagtctccatacggatgaaaaaaagctcagccaaatggaggaaagagcttataaaagaagagaggacgctcctgaaatcggtgacattacgagactgactccggcagaaacgaaggcgctgttccccgcgctgtcggaggaatacggggcggttcatgtcagcggcgcggcccgggtgaacgggagggcgcttcgtaaggcgctgttaaacgcggccgttaatcacggcgcggctgtttacaatgaagaagcgtcaatattgacagaggacggtgccgttatcggtgtgaaaaccgcagaacgcacgcttactgccggccaggttctcgtaacggccggcgcttgggcgagagagctgcttgaaccgctcggcatccgtttttcagtatcataccaaaaggcacagatcgttcatttagagcttcagggagaggatacgggcggctggcccgtcgtcatgcccccaaacgatcaatacattctcgcctttgacagcggcagaatcatagcgggcgcgactcatgaaaacgataccggcatggatttgcgggtgacggccggcggcctccgcgagatttttgacaaagcattaactgtggcgccggggctttcagacagtactgtgatagagacaagagtcggtttcaggccgtttactcccggttttcttcccgtcatcggcaaagtgccgaatatcagcggactcctcgttgccaacgggctgggcgcctcagggctgacgagcgggccgtatctgggggcggaactggcgaaactcgcactcggccagcagacggaaattgatttgagcctttatgatccggccggggcgcttgaataaaaaatagcttttggcgcattcttatgataggatggagctttaatgaataagaggacgtgacccattttgataaaaataaaccttcctgctcctgatgtaacgattacggaacggcagcagtcaccgtcggaaaatgaaccggcgattaaagcgatttacggtttcattgattttcaccgcattccgagagacaaaggcggcatctttatgttttataacattcatgatgaactgctgtttgtcgggaaagcccgtaaattaagacaaagaatcaaaaagcattttgaagacaatgtgtcgcctgttaaacatcacagggacgaagtgtataaaattgaagtatgtgtcgtcaatgatccgatggaaagggagatttacgaaacgtacgcgatcaatacccttcagtcgaaatacaacattgagaaagtattttataaataagaaaaaccggagcttaagggctccggttttctttatgtttacagtgccagccacatcactgcaatatgcacgatcagcagacagtaaacgacgaggaacagctgaacgaccttttttctgaataacatgcagatcatcatgagcacaggaaaaatcaggacgccggccgttttattgattgatgtattcggacggttcgacacgtcatagtgaatggccatatcagcaggaagaaacggataaaacacaatcgacagaataaaggcgagaaccacagctccccacagcaccttatcattcatcaaaaacatatgaacactcccttttttacctataatagtattttagtgtgaaaaagttcatttttcagtatttatttgatggctgtgtgctgtatgggtatttttaaacgcggcggccgccattgagacgatcgctcttgcggtagcggccatcattttgacagtagcaagcgttgacgaagattccgatttaggaaaagagcagctcatcgctaatgtcgttgaccgcattaacgcacagcactgaggatgaagaaagaaaacgctaaggagacgagccttagcgtttttttgattgaagcatctgttttaaatatgcttctgaatcaaagccgagttcctcgtcggcttcttttttcagttcaagctgaagtcgcacatacgtgtcatatttcgggctgagcttttgaagtagattgctgaaaggcgatccttccttcagcgcgggcagatcagaagcggattctccgatcttgatcaggctttctctgtactcttcatctgtctccactcttttcacaagctgaatgatgatgtttttatgagtgtcccaagtggcggggtctctctccaaaatccgctcgataaattggtcatgctggactttgtgctgttggagctgagccgggtcctccttaccgaccagctgcatcatcgggtgtgcagccggaacttcttccatatcatccaatactttaataagctttgcccatatcgtttttttctcatctgtatcaatagaaaagtcgaggaacggttcaaacagcgcggcgataaattctccgaaatctcccgggaacagttttttcagctgaagtcccatatacttcggttcatctattttgacctcgccgatatcatgcagaattgaatcgacattttccgcatcttccacgcgcttgatcagcatttcagtcagtttccgttcctgctcaagctcttcaatctgccggctgagcttttgatgctgctggcgcagtatatcatgcagactgctgccctctaagaggaacgctttaatatcgcttacagacagtgccagcattcggagggcggcaatcattttcagcgtattcacgttctgagcggaatactcacggtatccgttatcagggtttttgctgacggtgattaaaccttcctgctcataatatttgatggcttttttcgtgagacccgtctgcctggcggcttcttttatattcattctgaatcactccctgcttttcattctaaacgtgtctctaagggtcaggtcaagaaagggcgggaaattagacgggtttattctatattttagaaatttcagaaaatatgattgacaacgcacctttgttgcgattaatataacgttatataatgttatataacattatataataaaacactgaggagtgaaggatttgagtcaaactgccgcacaagtgaatcacaaggttcaggctttcttggatgatctgaaaggaaaaacgattgaccacgtctttttcgtcgcttgcgggggttcttcagccattatgtatccgagcaagtacgtgtttgacagagaggcgaaagccatcagctctgatctctacagttcaaatgaatttattcagcgcaatcccattcagctcggagagaactctctggtgattttatgttctcagtcaggcaatacgccggaaacggtgaaagccgccggtttcgccagaaaaaaaggcgcgcttacgattgcaatgacctttgagcctgattcgccgttagcgaaagaagccgaatatgtcgcggtgtatgactggggtgagaacgcacaggcgataaatacgaattacggggttctgtatcaaatcgtgttcggcgctttacacgtgctggaaaaccatcccgcgtttgagcaggcgatcgacggactcaataaactccagaccgtatatgacaaagcgcttaaacaagaagcggatcacgcaaaggcattcgcgaaagcccacgaaaaagaagatatcatttacacgatggcaagcggtgcgaactacggcgtcgcttactcctacagcatctgcattctcatggaaatgcaatggattcattctcacgccattcatgccggagaatattttcacggaccgttcgaaatcattgatgaatctgttccatttattatcctgctcggcttagacgaaacaagaccccttgaagagcgggcgctttccttctcaaaaagatacggcaaaaaactgactgtgcttgatgcggcagcatatgatttttccggaattgacgattctgtaaaaggctacctggctcctctcgtattaaaccgggtgctcagaagctatgcggatgcgctggcggaagcaaggaaccatccgttaagccagcggcgttacatgtggaaagtcgaatattaagaacgcgcattatatttcaccggactataatgatatataacgttatagtccggtgacaaaggaggaaaagcatctgaaaaagctcatctgcctgttcgttctgttagctgtatgtctgtcagccgccgcctgttcaagccaaagcagttcctctgacggaaaagtgaccctgaagttttttcacaggtggccgaaggagccggaaaaaagctattttgaagaagcggtcaaagattttgaagccgctcatccggatattcatatccaaacggaagcggtcttaaacgattcttataaagacaaggtgaaagtcatgctcggaacaacgagcccccctgatattttcttttcatggagcgaccggtttgcttataaattcatcaaaggagataaagccctcgatctgtcgtcttactatcagcaggataaagattggtcctcacagcttgtgcagtcacaaatcaaaccctttacgcatgacggaaaacagtacggtgttccgtggcaaatggacgctaaatcattcttttataataaagacatttttaatacattacatttgaagcccccggcgacatgggatgaactgatcacagtctgtgagaaattgaaagagaacggatatattccgatcagtttcggcacaaaagcgccttggaccatttctcattatatcgggacgctgaaccagcgtatggtggatgaaaaaacgcgggcgaaggattacagcccggaaaccggggagtttacggacgaaggctatgtcaaagcgcttgaaaagcttcaggaacttctgccgtactttacaaagcacgtgaactccgttgatcacgaatacgtgcgccagcagtttacgagcggcaaagcggcgatgatttatgcggaaacggcagaaattaagctcgtcgaaccggtcaatctgggcttgtttcctttcccgaaaatcagcggcgaaaagggatctccccgtgcactgaccggatctcccgaaggatttatgatttcctcaaaaacgaagcacccgaaagaagccatggaatttcttcagtttttaacctcgaaaaaaatgggagagaagctgataaaagacgtcggtaaatacagcgcggttcagggaacggcgacagaaaacaattccaccccgatccagcgcgaagccgtgcaggatatcgtccgcgccgaaacaatggtgccgtggtttgatatggatgttgacgttgaaatcgccgatgtgtatgcggcaggcgttcagcagatgctcggcggcacaatgacaccgcgcgaggtgatgaattccgtgcagaaagcggcgcgtcaggtcaaagcgtcatctgaatagaacagatttctttggagaaaggagatgaggatttctttggtcagccgaaagcgtttcattccgtatctgtttctcgcgcccgcgctggtttttctgctgttcgtttacattccgattattgagaatgtgtttttcagtctgtttgaatggagctcatttcaacccgaaaagacgtttatcggtttgaaaaattatattgacctgttccacgatcccgtgttttttacagcactccgcaacaatgtgctgtatgcggtcatatcgctgatttgccaggttggcggcgggttaattctggcggccgtgctggaagacagattggtaagaaaatggtcgccgtttttccgtacggtattttttcttccggtcgtcatttccatgaccgtcattgcgctgttgtttgattttatttataacccggaaatcgggcttttgaatcagctgctggaagccgtcggacttgatgaactgacccgggcgtggctgggcgatgaaaacaccgctatgctgtctgtcatttttgtgtctcaatggcagtctgtcggttacatcgccatgctgtacattgtctcgattcagagcattcccgctgaattatatgaatcggcgcagctggacggagccggaaaaatccagcagttttttcacattacggtgccgcagacgaaagaaatgtcgtttgttgccgtggtgatgacgctgaccggcgcatttaccgtatttaatgaaccgtatattctgaccggcggagggccgggcaatgcttcagaagtgctgagcacatttttgtataagagcgcttttacaaaggatatgatgggctacgcttctgcgatcgcgacggtggtgcttttgctgacgcttgctctgtcgcttattcagatgaaattctttaagaccggaaaggaggagtaggccgatgcttcctgaaaagacggacttgcgtcatgcccgtcaggccgtcagaacaggcggaaaaccgagaaaatggtatgtcggggaaacgtctgtgtggctgtttctctttatctacctcattgccgttgcttatccgctgttatggatggcggtcagcgcctttaaaagctcggatgagatttttgagcacagctggtcgctgccctctgtctggcatcccgaaaacttcgtatccgcatggaaccaagggatttccgcttattttatgaacagcgtcattgtgaccgtgctgacttgtctcatcaccgtatttgtgagtgcctgggcggcatacgggctggcccgttttcaatttaaaggaaaagggtttgtgctgatcatttgtcttggcggcttgatgctgacgccgcaggtcagtcttgtgccgctgtactccattatccagtcattgggactgtacaatacgtattgggcattgattcttccgtacgcagcctatcgtattccgtttaccgtgattctgatccgttcctattttttgtcgatttccaaagagcttgaggaagcggcctatctggatggatgtacaagtttcggaatatttttcagaatattcttacctatgagcgtgccgattctggtgacatcaggcattttgacggcttaccatacatggaatgagtttatgtttgcgattatttttatcgatgatgaaaatttacggacgattccggccgggctgatgcagttcagagatgcgctgcagacggattggggcgtgctgctggccgggctgacgatttctgctgctcctattatcgcgctgtttttattaatgcagagatattttatccgcggcattgcagcgggaagcgtgaaaggataagggggatgaaaagatgaaactgatagcggccggagataatgtagtagattattatcaggatcaggagacgttttacccgggcggaaatgcgttaaatgtagccgtgcttgcccggcgcttaggccacgaaacttcttatatcgggattctcggcagtgatgaagcggcggatcacgtattgaatgtgctgaaactggagaaggtgaatgccgatctgatccgccgggcatacggagaaaacgggatggcggtcgtcacgcttgatgaaagaggggacaggatatttgccggatcaaataaaggcggcgtgcaatcgcgtctgacgctcgcttttcaggagaatgacatctcatttatcgccggacatgatctgctgcatacgagcgtatacagcaggatagaacgtgaccttccgatgctgagcggccatgtgccgatttcctttgatttctctgtaaaacgtgacgaagcctatttagaagcggtctgtccgtatgtgacgtatgcgtttttttccgggagtgatttgagtgaaagtgaatgtgtgcggcttgccgaaaaagcccgcggtttcggagcgaaaatcgtttgtctgacaaggggagaacatggcgcggtgttatcggatggggaacgcgtctatcatcagccggtggtaagagctgatataatagatacattgggggcgggtgattcttttatcgccgggtttcttaccgatttcttcgaacatcaggatattcggcgagcgcttactgcggccgccgggacggctgccaaaacatgcggggggttcggagcgttcggttacgggcatccctacaggccggacggcgggaaaagcagtgaaaaaacgagaatacgataagcattgtctcgttttttatacttgttacgcataggggctgttaatggtaaacgtgacgcggtcggtatgcattaaaaacagcgaactgtatatcggctgttcttttgacataaaagcggttttgtcaatttcaaaaagcgcatccccgatatcacaagccagatagcggctttcttcctgcttggcgtatacgacatttaacagtttcgtattatgggtgggcaccacctgatagtgctgtttcaaaatgtcatgcatcgacacgccgcctttaatatgcttgccgatgtcgggaaataaactgagcggatagtgggcgatttcgaatgagagcggctggtcgtcgtgaaataaaatgcgttttaattcaagaacgggactttcggaagcgacgcgaagtttttgagcgatggatttaggcgcttcaatgatttcatgggaaaggatctggtgtttcggtttttttcccgttgattccataaattcagagtagccgttgaccgcgatgagctcccgcttcagtttagggcttttaacgaacgttccctttccctgctgccggacgagccagccttcttccacaagatcaaggatggccttcctgactgttatgcggctgacgttgtacgtttcgcacagctcattttcagtcggcagttttacggacggcgaataaacgcccttcttgatatcgtccgcgataatttgtttcagctgaatatataaaggtttcgagctcccgttatttaacaatgggacggacctcctttgtcaagtagtagtactattatatgtattatgatgttataatacaaatttgcctttcatttatgaatctgtcagaaaccccgaacatttttaacataacagaaagatgtggcggtttccagtattggaggaggtttcgaatggcatcattaacatttgaccatatcaaaaaaacatacggcgcccaatcggcggcagtgaaggattttcacttagatgtaaaggatgaggagctgctggtgcttgtcggtccctccggctgcggcaaatctacgacactcagaatgattgccggactggagagcatttctgaagggaagctttatatcgatggagacgcggtgaacgatctgcccccgaaggatcgtgatatcgcaatggtttttcagaattacgcgctgtatccccacatgacggtgtttgataatatggcgttcggtttgaagctcagaaagctgccgaaaaaagaaatcgcagagcgagtccggacggccgctgatattttggaaatcgggcatctgctcaagcggaaaccgaaggctctttcaggcggacagcggcagcgggttgcgctcggccggtcgatcgtgcgggagccgaaagtgtttctgatggacgagccgctttccaacttagatgcgaaactgcgtgtgacgatgcgcgccgaaatcagcaagctccatcagcgtttgaaagcgaccatcgtttatgtgacgcatgatcagacggaagcgatgacaatgggtgaccggattgtcgtcatgaatgaaggaaatattcagcaggccgcaagcccccatgagatttatcattatccggcgaatatgtttgtggcgggttttatcggttctccgagtatgaattttataaaaggcgtcatagaagaaagtcacgggcaatggtattttgccggttcgtccgttcgtctgcccattccgaaagaaaaagcggccgttcttgtgcagaaaggatacagcggtcaggagatgactgcggggctgcgtccggagcatttgacgcttgccggacaatcagagcacccgcctgaagcggtgtgccgcgctgtggcggaagtatgtgagaacttaggcgcggagatgtacgttcatgcggtgagcggagatgaccgcatgacgatccgccttgacggcgcttcagaggtgaaacccggcgatgccattctgcttgcggtcaatatgaaccgggccgtgttttttgatgccgacactgaaaacgccgtatattgaaaaagggagcctgatgatggggctcccttatcacttcttatgatacgattaccagatttcgtccgcccattccgggtggtcgataaacggattgcggttatgctgatagtcttcgtaaatgatttcgttccgccgtttttccttactgtcgacggggtcttgtttattccatttgagcaaaacggacagttttcccatgtaaggagctgagccgtttccggttttatcattcagctcaaggtcgggatacccgtcgccgccttcataacgcaccgccatgtaaaacagcatgcgggcgacgtctcctttgacctcatcgcgcggctcccaggaatcaccgtcataataattgcccggcgctttcgggtattctgagccgccgttatcaaaatccatgtttcctctggcgctgttcacctggacgtctgcagggcgcagatgatgaatgtccgtcccggggccggcagctgttccgaagtttccgtgtgactttgcccacacgtgttcacggttccagtccccgacgctgccgccgtttttacttttggcccgtgattcctgggtgtagagcaagatgacattgttcgggtttgccggatcttcgtcagtttccttcaatgcattccatacttggctgtaagacagctttgtatgtccgctgatgatgcggtgcagggcgctctttaaggctgttccgctttttccggaagcttctttgtaatatgtctccgtatccgcagacggagtgatgacagctgaggaagtttgcggaaaaagagttgtgccgccggcagttgaaaccgccagccggctgtacagattcgtgtcagccggcgcgcccgcagaggctgacggcgcggtccaacccaaaatgaaaaacaggcagacaatcggcagaaaccaaagtttttttgtcatgacttgccctcctttacctctattatccaaaaaataaatctaatattctatcttttttgaaaaatggttccttcggcttatgggacagaggggcggtttcttggtcaaagtatccggaaaatcattgattttttggaagatatgataatgaactcgttatgcgctccttctataatgaagatcatcttgtcagtttttcagtttaaaaggagggcatatatggaacatcagcagctttcggcggcgaatatcgggatttccgatgacatacaatggctgtctcaattcggcgcttccgcttccggcggagtgacgaggcttttatatacgaaagaatggatggacgcccagcttgccgtcaaaaagaaaatggaggcgttcgggctggaaacggcatttgacgatgtcggtaacgtgttcggccgtctgagcggcacagaatcgcctgatgaggtgattctgaccgggtcgcatattgacaccgttattgacggcggcaaatatgacggtgcgttcggcgtgctggcgggcatgctggcgatccggcatttgcatgagacgtgcgggcgtccgaaaaaaacgctggaggctgtgtcgctctgtgaagaggaagggagccgttttcccatcacctattggggctcaggcaatatcaccggtgctttctcgctttcagatgcggaaacgccgaaagacgcgtccggcatttctctgaaagaagccatgcggcagaacggcttcggtgcaggccgttatccggcgccgctgcgcactgatattagtgcctttctggaaattcatatagaacaggggcaaacgcttgaacgatcgggaaaggatatcgggattgtcaccgggattgccggacagagacgctataccgttacgcttgacggtgaatgcaaccatgcggggaccacttcaatgaaatggcggaaagatccgctcgcggcgggaagcagcatcatccatgaactcatgctctcagcggaaagacagccggaagagctccgcctgacgtgcgggaaaatgacggttgagccgaatatggcgaatgtcattccgggccgtatccagttttccgttgatattcgccaccagcaggaagacgtgctggcagccttccatcagaaactggtgtcgattattgaaaacatcagccgcagcaaaggagtcagaccctttattgatgaatatatgaggatagagccggttcaaatggatcacatactgacacgaaccgcagcacaggctgcaaaagagcagggggcggacccggagaagatcgtaagcggagcgggacatgacgcccagatgctcggcagaacctttccggcctgcatgctttttgtgccgagccgtggcgggatcagccactcgccgcttgaattcacacccgcacatcagcttgaaaccggcgtccttacgctggcgaatgtattacataaacttgcttattaacgtaaagggggaatcggcgtgccgaccagaaaagaattgtgcattccgcaaagaacgataatgacaccgggaccgacagaagctgaaccgagagtgctgagggcgatgggcgctccgatcctcggccagtttgacccggcatttaccggtatcatgaacgaaacgatgcaaatgctccgtgaattgtttcaaacggaaaaccgctgggcctatccgattgacggcacatcaagagcggggattgaggctgttctcgcaagtgtgatagaacctggcgacagcgtgctcgttccgatatacggacgcttcggacacctgctgactgaaatcgccgagcggtacggagcggacgttcatacgatcgagtgtgaatggggaacggtcttccggcctgaagagattatcggcgagatgaaaaagatttccccgaaaatcgtcgctatggtgcacggagaaacatcaacggggcggattcatccgctgaaagaaatcggggaagcgtgccgcgcccaagatgcactctttatcgtggatgccgtggccacgattggcggatgcgccgtaaaaacggatgaatggaagattgacgcagtcatcgggggaacgcaaaaatgcctatcggtcccttccggaatggcgccgattacttataatgaccggacggccgctgtcattgccgcgcgtaaaaaggtagaacggggcattgcgacagcagctgacggtaaaatgctgtccggtcatcggccggttacgagcaactattttgatctgagccagctcgaagattattggagtgaaagaaggctgaatcaccatacagaagcgacagcaatgctttatgcgctgcgggagggtgtgcgccttgttctggaagaaggacttgaagaacggttccgcaggcatcagcgccatgaaaaagcgcttacggcgggacttgcagcaatgggccttgatttattcggcgatccggaggcgaagctgcctgtcgtcacatgtgtgaagattccgccggaagcagacggcgaatcgataaggagtatgcttttgtctcaattcggaattgaaatcgccagttcgttcggtccgctgcaggggaaaatttggagaatcggaacgatgggctacagctgcagaaaggaaaatgtgctgtttgtgctggccggacttgaagcggttctgatcagacacggagttgcagttaaagccggggaagcgctgcaggcggcccttaacatatatgatctgccggctgaaaccggtatgctgtcatgagatatgaaaacgagattgaaatcatctggacttttttcccttttccccgttatactgaatggtataaaaaatgacaaatatggaatgatcatctgtttgtctggggagaaggtaagaaatcatggcgtacatggggcgattgtcaattttaatgctgaatatgtttattgcgatgcttgggatcggattgattattccgattatgcccgcatatattaccgaattcggagcgacggggagcacgatgggtctgcttgttgcggcggcggggcttacacagcttttatttgcgcctattgccggggaaataaccgacaaatacggacggcggaaactgattattttcggcattgccgcctttgccgtgtcacaattgatcttcgcctttgccggaagcctgtggcaattgttcgcatcccgccttttgggcggaatgggcgcggcgtttttaatgccgtcaatgttcgcttacattgcggatattacgaccgaggaagaacgcgggaaaggaatggggctgttcagcgcggcgatgacgctcggtgtcgtcatcgggcccggtgtcggcggttatttggttcattacggcatgtctgtgccgttcatcgtgtccgcaagtctcgcctgcttttcaacggtgctttcatttttctttctgcccgaaacgctggggcgtgaaaagcagctggaagcccgggcaaaaacggaaaaacgtgagcatctgtttaagcaaatgtcacgcgcgctcaaatcgccgttcgcgtttatgctgattctggtttttgtgctgaacttcggaattatgaactttgaatccgttttcggcctttacgttgaccataaacacggatttaaagcctctgatattgcctttattattacggctgcgggtctcatcggcgtatttgtgcaggcggtcggcgtcagttatctcgtccgcaggttcggggaaaagcgcgtcattaacgtgacgttgatcggggctgctgcaggacttgtgtggtgccggtttgcgggttcatattgggccgtttttgccgcggcaatctttttcctgacgctgacatcgctgctccggccggccgttaatacgatgctgtcgaagctcgccggtgaccagcaggggtttgccggcgggatgaacacctcattcatcagcttagcgaatatcgccgggccgtcggccgccggttttctctttgatgtaaatatggaatttccgtatatgctgggagcggccattctcgccatcagttttctggccgcgcttggctggggcaaaaagacacagacccggccgttcacgcagcaaggataagaatcaaaagcctccgggtatccggaggctttttgctgattgtcgtttattctgcggctgtctgcatctctgaaattgcagagatgcgcatagagggaaaatcatatagcaaaaacagttgttccgtatgctcaagcatggcgcgaatggaaaccggaacaggtgtagataaagtaaaaccagctttatcgcttgacgagtctgatgaatttgatctgccggaagttgatcaaaaaagaaggcagtcaggcaggcagggacaacattgagcggcgtaaatgctgagaaggaaaaagcagggttttggaacttgctgtttcgtatgcagggggagagcattctgataaaacgggtcattgaaataatacgaactgttcagtagggggcgattggtgacaacaaggagaggttatcttataaaacctctcccggaagatgttgtgatggttctcctgcatgaattttgcagattaaaacccgcaattaggccaacacacaattatgcaagagacaatcatctaaaaaggatgtcggtaagtacaatatggtgtacggaaaaggagttgaaaatgttgtattattacccgtcattccatttgtatcagcggcaagaatttaattattatccatgggcccatcaattgactcattcagggggctccccctatgtttccgcgcgccctcctttttataattccccatgttacagagagtgcataagaagcggagcggatagttatttctgctgctatatctgcggtttctgttaaaaagaaagacttatagaagtaagtgatctttccaggatgacagtgagaccattatccagacagccattagccaacacacgaagctttattacggttcacggaggggaagcgcccctcctttttcagaaattttataaaatccccttgcgcggcctgtcagaagcggtttttggtcttgatgtgttcgactgttggtgttgacgaagaattcaagataccaggaagcagcgaaacctgtatgtatccgcgagacacaaagctttccgccgctgagcgggttcattgtcactgcgttctgtctcctgtagtagataacgagattttggggctgtcagttgaggaaaaataaaaaattcaaaacgtcgcaatcgtttaattaaaaagaagagatagaatctatctcttcggattattactgaactacaaaatggtatcgggttttccaagtggaggaatcatcatagaattcaatccaggcttctcctttagcgactgcaaatacctgaatggttttgtagtcagtacctaaagctctccatgtcacagcaggagggttataacccgtaggattaaaggaaatgcgattaccagaagtagaataattccttatctctcctacttttaaattgacgcgggtttcagactgagattgaaacaaattcttattcactttagtagagggaccggcggctgatgctgaagagttaaaaaaaggcgcgaaaacgaatgaaacaattgcaagtgataacaaagcatttttagctagtttcaacgtaaaacctccttttggtatttataggataacagtaacacttaatggaaatataacaatgaagaaattgttaaatattctttgaaatgagtgaacacatgccaagtgaattgataaatgcaaacatcatacatgtttcttacgtagataaggctgctaatcaaaagcggtttttttatgaaatcagaaaaggaaaagcagcatgactttcagggcggcgtggggaagtggttgagtcttgtgtcgctccccgctgattttcaaatgaatggcgaaaccatcaaaaaagggtcatgggtgcttgtgacaaaggttccgaggcagtttaggatgaaatcaaaaagggtgagattatcggttgcatcctgaatatcgaaaaagcctgatgatatcaatggcagcattttttgagggtttagctgaatgaatcccccttaaataggatgcgggagaacacccgcatcctggtctatggctaaattttaaccgatcagccgctgcattctcagcgcgagccgcaggcgcatcgtcgtctccggatcttttaagcttttgccgagcagttcctcgcatttttctaaacgatagatcaccgtatttcgatggacgtacaggcgcttagccgtttctgaaatctggcagtgggtttccaggtaaacagacagtgtatgaagcaggctctggtcctccttttgccggtcggccaggctttggagggtggcttcgtaaaactttttcacatcttccgccggaagcaggccgagcaactccggcacgtctttggcatgatagatttgaataaactccgcgcttctggacaaatgcccggatgaaatggcgtctgaagcttcagtaaaagcgtcagggacatcgatcagcttttggcatatgtttgagatgccgaaggagacagtccgtttaaactgcgtccggacctgtttctgaaactgctccaaaaagctgatgacagacgcgtgcatttcattccagctgtctgtcgcttcaattaaaagaataccgacatttcctttaataaagagatgagggggaaacggaaaggatgacagctccccttcaagcagatcaaatacatgatcggaaacgagctgattttcggtaaagctgatcgttttctcatttcggtcgagttttccgcaaatgcacatgtatttctgatcccagcggagccggaattctttggcacggcttttgatttcttcatggccggtaaacgagcggtcgatgaaattgctgaaaaattcattgcgcgcccgtctgccgaattgtttgacggcattttctttcagcagttcaaaggaaatgacgttggccgcctgttcaattgtcaaaatcatgcctttatcagcggtctgcaccagctccggaatcaccagataaccgcagtttttttcaacattcagaatcggcaggacagaatacacctttctgtcggagagcatggaaaagcaggtgaaataaggaccggaaagggaataacagatgtttttcaataaagacgtgtcaatgggtatgctgtgggacgatgataagagttttgtatgctgatccaaaagcagcacgggaagccggagaatgtctgagagcttcttaagcagggattgcagccctttgccgctcatgatgtggtttgtaaattttttatgggcgtaaatggcctgctgcagctcatttgaacgcatatcaagaatatggctcaatgtagcattgacgatatctcccagcctgatgtcttccggcagctcaataatcggaaattcataccggtcggcaagctctgcggcatctttcggaatgacattaagatagcgcttcgttttgatccccagtcccgcgcatccccgttttgccatgaggcggattaaatctttcaacagctgcgggcggtccttcaagtggtaagccgtcgtgacgagcaattcgtttttatgtaaaaaatcagcgatgtccggcgcatccatcatgttgacgtgctgcacctccctccagccgccggatctgcctgcgattaatgcggcccgctcataagcgggaatcttcatcacatcataaatattcatcagtcaatctcctttcaggttctaaagacaaccattggttaatatgaataaaagtcatcaaaaattatagcggttttgctgatgtattacgatcatagtagcagtaaactggcaatcatagacgcatgttgtgataaaaactgacagaaaatcgtcatccttacagggaggaagataaaatggcctatgacgtaattgtaaagggtgcgaaagctgtgcgaaaaggcgggacagagcgggccgatatcgccgtcaaggacgggaaaattgcattgatcgagcccggcattgacgaaaacgcggaacaagtggtgcaggcagacggcatgtatgtgtttccgggcgcggtcgattgtcacgtgcatttcaatgaacccggacgcgaagaatgggaaggcattgaaaccggctcaaacatgcttgctgccggcggctgtacggcttattttgacatgccgcttaactgcattccttcgacggtaactgctgaaaacctgctggcaaaggcggaaatcgccgaacggaagtcagcggttgattttgcgctttggggcggtttgatgcccgggtataccgaacatatccggccgatggcagaagcgggggcaatcgggtttaaagcgtttctgtctaaatcgggaacggatgaatttcaatcagccgatgaacggactcttttaaagggaatgaaggaaatcgcggcgtgcggcaggattttggccctgcacgcagaaagcgacgccctcacccgattccttgaagccgagtacgcgctccaagggaaaattgatgcccgcgcttacgcttcctcccgtccggaagaagccgaatgcgaggctgtgcagcgggcgattgaatatgcaagagcgacgggatgcgcgcttcattttgtacatatcagcacgaaacgggccgtgctctccattcagcaggcgaaaaaagacggattggatgtcaccgttgaaacgtgtccgcactacttattattcagctttgaagacttcctcaaaaaaggggcggctgccaaatgcgctccgccgctccgctcagaggctgataaagaggaattgatcggggttttggctgaagacctgattgatatggtgtcttcggatcattctccctgtcatccggctttgaaacgcgaggataatatgttcctgtcgtggggcgggatcagcggaggccaatttacgcttctcggcatgattcaattagcgatcgatcatgggattccgtttgaacatgtggcccgatggacggccgaagcacctgccaagcgtttcggtttaacgaataaaggccggcttgaagaaggatttgacgctgattttgccattgtccggccggaaccttttaccgtcacaaaagaaacgatgttttccaaacataagcaaagcctgtatgaaggccgcacctttccataccgaattgctgcgacctacagcaaggggtgctgtgtgtatcaggatggcggtcgtaagcagagcgggtctttcggaacattcctgaagccttgtgaaataaaaaagccgattctctgatgagaatcggctttttttgtcgtttggaaagcgggtctcgtggtatctttttataaaaaggagtaaaacacattgtatgatcaaatcttgaacatattaacggcatcctggtcgcgcaagaccagtacaaaatggacggaagattgcccggccacaggccagtgcggcgtgacggctttagtcatccaagatgtttacggcggtgacattctcaaaacaaaaaccggcacaagctggcatttttataatcgaatagacggggagatatatgatttcacgagcggtcagttttcagagccgatcgtctatcagcatattctttcttccagagatgaggcattttcggacaccaatgaacatcagtaccgttacctgcaaagtgcattcagaaaaaacatggaaacggaaagagaaaaacacctgtgataaactagaatgagaggtgaaggattgtgatttatatcggactgacggggtggggggatcatgacagcatctatccgcctaaaacagcgggcccgcaaaaactgcaggcgtattcctcccattttcccatcgttgagctggacgcgagcttttacgcgatacagcccgcccgcaataacgaaagatgggtcaaagagacgccggaatcttttcaatttgtcattaaggcatttcaaggaatgacgggccatcagcgcggtgatattccctttgaatcgaaggaagaaatgtttgaggcgtttaagctgtcattatcgccgtatatagagcatggaaagcttgccatggtgctgttccaattcccgccgtggtttgactgcaagaaagaaaacgtcgcatatttaagatggtgcaggaagcagatgggcgatatcccgtgcgcgcttgaattccgcaaccgatcttggttttccccgccattttacgaacagacgctttcctttatgaaggaggaaggctggattcacagcatatgtgacgagccgcaaatcggcgagggcagcattccgaccgtcctgaaagcaacggatgaagaaaaaacgcttgtccgttttcatggacggaacaagcagggctggatcaaacctgacggcggacaaaactggcgtgaggtcagatatttataccgctataacaaacaggagctcaaagattggaaaaacaatcttcaggagctgaaaaagcagtcgcgcaatctgtatgtgctcttcaacaataactcaggcggagacgccgccgataacgggcttgagatgcttgaaatgttagatatctcatataccgggcttgctccgaagcagctcgacctattcagctagaaaagaggtttcaagacacatgtcttatcttattttgattatattgggatttatcgcgggaacggtcggcagcctgatcgggcttgggggaggaattatcatcgtgccggcgatgctctatttaagcacgatgaccccgtttttccatgacgtaacaccgcagactgccatcggcacgtcccttttggtgattatttttacgggcctgtcatcaactctggcctatatgaaatataaaaccgttgactacaaaagcggactgatcttttttatcggttccggcccgggaagcatcatcggcgcgtatttgtctaaactttttaatgcgcatacgttttccgtctggttcggactttttatgattttgatttctattacattaatgctgaaggcgaaagcaaaaccggtcaataaagcgcataaaggcatgatccggacatatgaggatgaaacgggtgagctttatacatattcgtaccgtatttttaccggtatcgccattgcctttttcgtcggtttattgggcggtcttttcggcatcggcggcggctctcttatggttccggccatgatgctgttatttttgttcccgccgaaagtggctgtggcgacgtcaatgctcatcattttcttatcctccgtgacgggttccgtgtcacatatcgcagagggccatgtcaattggctgtatgcgctgtgcctcgttccgggcgcgtggttcggcgggaaaatgggcgcgtgggtcaataagcgggtgcagacgaaaacgatcgtgcttttcatgcgggtcgtcttgattttgatcggctgtgaattgatttatcaagggatattcagctaaaaggtaggagagatggtatgttagagaaactccgtttatatcatacgaatgatttgcacagccatttcgaaaattggccgaaaatcgtacattatattgagcagaagagaaaagagcatgaaaaaaacggggaggaaacactcgtattcgacatcggcgatcatatggaccgatttcaaatgataacggaagcgaccttcggcaaagcgaatgtcgacttgttaaaccggcttgagatcaatgcggctgccgtcgggaataatgaaggaattacgctgcctcacgatgagctggcgggtttatatactcatgccgcgtttcccgtcattgtgtccaacctgtttgacgcggacggacagcggccggaatgggccgagccctacgtgatcaaaacgctgaaaaacgggatgaccgccggcatactcggggtcacggtgccgtattatcccgtctatcagaaactcggctggacggtgacggatgcggaaaaaagcattcaagaatcacttgacgatatcaagggcaaagcggacatcatcattctgctttctcatttaggcctgatcgatgaccgggccgcagcggaaaaatttcccgacatcgatgtcattcttgaatcacatacgcaccaccttcttgaggacggacaggatataaacggcgtattgcttgcatgtgcggagaaatacgggaactatgtcggctgtgtcgagctgacgatagaaagtgaatcacgaaccattgtcagcaaacaggcatctgtacagaaaatggctgattggcacggggaatctgaagatacggcggcttttctgaaagagaaagaacgggaagcggaaaacctgctctccgtacaagtcgccaatctgaatgaagaagccggcgtgaagtggtttgaggaatcgccgctcccgcttctattagccgaagcgctgaaaagctggtgcggctgtgaagtcagcatggtgaattcaggcgtcattttggggcctttacagaaggggcctgtcacaaaacttgacttgcaccgcatctgccctcatccgatcaatccggtcgccgttcgtctttcaggcagggaactccgggaaacaatcagccaggccgcctcggaacaaatggagcagctgcggattaaaggcctcggcttccgcggggaagtgatgggcaggatggtatatgccggagcggaggcagaggccggcatccttgaagacggtgtgacgcatctcctcaatgtgaaagtgaacggagaagaggtggatccggagcggatatactcggttgccgttctcgacatgtttacactcggaaagctgttcccttacatccgcgattcaaaagaaaaacaatattttatgccggagtttttaagggatctgctcgcctggaagctcgcgcggcaagcgtaatgtcaaatatccgccggccgttccatctcacccgaatgaaggtaagcgggactttttaagagcaaaaataaaatactatgtcccctcttacaagcatacattgtgatatgtaaggggggatttttcttgcctagataccggagcgctcttcgcaagagagggcctttgccttttcgatatgtgcttcttctgtcgtttgctttttttatcatatcgacggtcatcagcctctggatgatcaactcctcaatcaaaccggtgctgatgaacataggagaaatggaaaccaaacgggtggcgacagaggtcattacggaatccattgaagaatacatgtctcacagcgacaatgtgaaagatatggtcgatatgaaaacggatgaaaacggaaaagtcacaacgatggattttaatacacaaatggtcaacagcatgaaggcgaaagtgacaaagcagcttcaggctcatttgaaggaagcggagtcgaacaataagcagcatgaaacggaaaaaggcgcgaaaacggccgatgaaattatgattaacatccctttagggcaggtcacgggaaacagcgttctcggaaatctggggccgaaaatccccgtgcgctttaacctgatcggtgatgcgttaactgatgtgaaaacaaaaataaagccgtacggcattaacaatgccctgatcgatatcagtatttttgtggaaattaaagtgaaggtcattattccgtttgccagtaagacatcagtcgtcacaaataatattccggtctccattaaagcgattcaaggagaggtgccgcagttttataacggaagcggcggatcaggtgtgacgccttctgtccagctgccgagtgaaaaacagaagaaagataaataaaaacacacagccgcaatctttcctggcggctgtgtgtttactttttcctgcggatttcttttcgctcccatgcccttaaatggggatacgggtcaaaagaccattccgatctgccgttatctttatacatcccgtagtgaagatgcggcggaaattttcccgcggtgcccggcggtccgtatccggaactgccgacagagccgatcacctctccgggtttgacgatctggcctttatgcacaccttttgcaaagccgttcaggtgagcgaagtagtgatacgtgttattgatatccctgatgccgattctccagccgccgaaacggttccagcccttcatttcaacaataccgtagcaggtcgatctgacggggagtccgtaatgagcgaacagatccgttccttcgtgaatccggcgcccgccgaaaccccgtgcggcgccccatgtgctgcggtagctgtaatccgtcttcacgggaagcggaaaagcgtgctctccgagatcaaggcggccgaacgttttaaacagtgtcatgaattcggtgataatgccgaccgtctgatcacggcggtaataattccagaggccgatgcggatatggtcaagatccgttccgaatcccgctaaatactgtgcaaatgtataaaggatatcctcatcattgctgacctcggcttttccgtcgccgtcgccgtccaggccgatcccgtcaaatactttaatgctgaggggcgcctcgtccttaggatttggattttcaggcccgctccacaaatgatccggaatataaatgctgatgattcccgctttttccggcagatcctttcggttcgagcggacattttcttcatattgatcaaccgccgcaagcacataccaaggaatctgcgtgactgcttcggctttgcggtacaactgcatccgttcaccgtaaacaggagccgattgttctttcccgcttgcagccggacagaaaactgataaaaggagaagagcagataacagaactttcacaacatgatctcctttcaggattaatacaactagtttgcggcaacaatccgagaaaatgtaagtaattctcttcccttgtcgagaaatttttcctatgttaaagtgactattgaatagaaatctgcaagttttatatccatcgtgaaatagaaatttttcgcacacgaacatgaataaagggataatggagatgatggggaaatggcaaagaaagacgagcatctgagaaagccggaatggctcaaaataaagctgaacacgaatgaaaactatacgggtctgaaaaaattaatgcgtgaaaataatctgcataccgtatgtgaagaagcaaaatgcccgaacatccatgaatgctgggctgtcagacgtacggcgacgttcatgattctcggttccgtctgtacgagagcatgccgcttctgcgctgtcaaaacgggtctgccgactgagctggatctgcaggaaccggaacgcgtagctgattcggttgcactgatgaacttaaagcacgccgtcatcacggccgtggcgcgtgatgatcagaaagacggcggagcaggcgtctttgcggaaacggtccgggcgatccgcagaaaaagcccgttcacgacaattgaagtgctgccatccgatatgggcggaaattacgacaacctgaaaacattaatggatacccgtcctgatattctgaaccacaacattgaaaccgtccgccgcctgacaccgagagtccgggcccgcgcaacatatgaccgttctttggaattcttgcgccgtgcgaaagaaatgcagcctgacatcccgacgaaatcaagcattatgatcggtctcggcgaaacgaaggaagaaattattgaagtgatggacgacctgcttgcgaacaatgtcgacatcatggcgatcggccaatacctgcagccgtcgaaaaaacatttaaaagtccaaaaatattatcatccggacgaatttgccgaactgaaagaaatcgcgatgcaaaaaggcttcagccactgtgaagcaggcccgcttgtccgttcttcctatcatgcggatgaacaagtgaacgaagcgtctaaaaaacgccaggcccaagcataagataagccgaaaaaacccaaaacgccgcaggttttgggttttttgtgatggagccgtctgtgcagggaaaaagtcattcttgaataaggatcgtcagaaccgctacactggatataaaaggggaaaatttttccgtccgtccgaaccgtctcattttgcaattgatggacagaagtcaatgaattatgatagtaaagagtgataaaagaggtgaagacatgattcttattcaaaatgccgagtttgaactcgtacacgattttaaaaacggctttaatgaagaagcgttcaaagcccgctattcggacatattaaataaatatgattacattgtgggagactggggatacagtcagctgcggctcaaaggcttctttgatgaccagaatcaaaaagcaacctttgaaacgaaaatcagcacattggacgaatacatttacgaatactgcaatttcggctgcgcgtattttgttttaaaacgaatcagaaaataattgatgcagaaggggatgctgtcacgtgtattttgttgacagaaataatatcgaacaaacactccgtttttttgagacccagctggcgctgtttgacagcacgcctgcatggcagagcgaaatcgaaaaaagggcgcttgagcggatcagccatcttatgatcgaatgcattctcgatgtcggaaatgatatgattgacggctttatcatgcgcgatccggggagttatgacgacatcatggatattctgacggatgaaaaggtggtagctgaggatgaagcgaataagctcaagcagctgatctcttccagaaagcggcttgttcaggaatatcagcaagccgatcatcaggagctgtttacgctgatcacgtcaaacagggacgtgctgaaagcctttccggcccgtgtaagaacctacctggaaacagaattagggcctgtttccgcatttaaataacaacgagtgagaaaatccacaggagtgttgagtatgaaggattataaaggatatttgatagatttggacggcacaatgtacaacgggacggaaaaaatcgaagaagcgtgtgaattcgtgagaacgcttaaagcgcgcggcattccgtatttattcgtgacgaacaattcttcccggacgccgaagcaggtggcggacaagctgatgagctttgacattccggcaactgaagagcaggtcttcacgacgagcatggcgactgcgcagcatatcgcccagcagaaaaaagacgcgtcggtgtatgtgatcggcgaagaaggcatccgccaggccattgaagaaaacgggctgagcttcggagaagaaaacgcggactttgtcgttgtgggaatcgaccgcggcattacatatgaaaagttggcaacgggatgccttgcgatcagaaacggcgcccggttcatttcaacaaacggcgacgtcgccattccgactgaaagagggcttttaccagggaacggttcgctcacatccgttttgacggtgtcaacgggcgttgagcctgtctttatcggcaagcctgaatccattattatggaacaggcgatgcgtgtgctcggaacggatatttccgaaacactcatggtcggcgataactatgcaacggatattatggccggcctcaatgcgggcatggatacgctgctggttcataccggagtgacaaagcgtgagcatatggcagattacgaccggaagccgacatatgcgattgactctttaaccgaatggattgaacatctataaaaaagggacggccatgacggccgtccttattctgtatttctggcgctgtgggcaagccggcttgaagccgctgctgcgattgcgccgacgatatcatcaagaaacgtatggcattcccccgtagatttatcatttaaccgcccgagaatgccgggtttttctttgtcaatgtagccgtaattcgtaaagccgattgagccgtatatattcacgatagagaaggcgagcacctcgtcaaccccatacaggctttcatcaatcgccagaatggtctgaagcggttcagacagttttttttgttcggcgagcacatctaattctattcccgttaaaatggcgttttgcacctcgcgttttgcgatgacacggtccacattgagcctgcatacttccatcgtcaaatcaggatgatattttttctgaaggaaatacaccagctcggcaatatcgtccgtctcaaccccccgttcttttaaacgcgctctggcgacagcttccacctgattcagttgttccttttctgacatttgcttcacccaatctttttttactagtttatacaacacccttccgatgtgtacgatgtttctccacttgattcaaaggattacaatatgtattcataattccgccggcgtatgactacgatgtgaatagctctaatttttcaggcaggtgattatgatgaaaagcatcattaaagaaaagtacggcatccacgtcagacagctttccgtttatcagaaataccaatgcttccagacgcctaattccttctttcttattattcccgtttccgggttttcgcaatcagagctgacggagctttactacatgagtcagtatttacaagaacaaagtgacccatacgtttcagtgtttatctttacgaaggaaggagaactgacctttgaggacgaaggcaaaacgtatgcgctcttaaaagcgccgatccccgtcgcaaaccggtcgttctctgtcggaggggagcttgccgaatttcacagaaaagggcggggttttccgtacgaagtgaaagaagcgggcaggatcggccaatggaaggacttatggggaaaacgggtggatcagctggaatcattctggatgcagaaaattcatatgtctccgcttgaaccgttcgaaaagaaaatgatcgaagcatttccttattattcaggcttagcggaaaatgcgattcaatatttagtggatacggagctggatgacaatcccggcgcagaagactcggggacaatctgccatcagcggatggaacgggatacctggtcggaggaatcattgatccgcattccgggcgattgggtattcgaccatgccgcccgtgatattgcggaatatatgcgcagcacatatttgtatcatcgtgacgacttgcttaacgaagggtttttgtttttgcaggaatatgagcaagttacgccgttatcctccttttccaagcgcctgttttacagccgcctgctgtttccgcttcatttctttgagacggtggagagttattacatttctcatgattctgaaaaacagttttacgaagagcagcttgactacattcttgccgactgcacccgctatgaacagtttttacagacatgtcacgacatgatgaatgtcaggtcggcgcaggtttttgtcccgcctgtggcgtggctcggaaaaggaatcagttcgtaagaaaatataacgtaaaaatatttagaaaatagggaatcttgtcatatcaatgtgttaagcgttttcatggccgtagaaacaatattcagccgcttgtcaaaacaaatgcgggcttatataatatttgtaacttaaatgtctgtgaagggttaacaattgtccttttctagtggacaaaaggaagaaaggtggagtttctctttggaagcgattcgtattggactgttaggactgggaaccgtgggaagcggagtcgtcaaaattatacaagatcatcaggataagcttatgcaccaggtcggctgtccggtgacgattaaaaaagtgctggttaaagatattgataaaaaacgagacgcagacctgccgaaagaagtgctgacgacagaagtctatgatgtgatcgatgaccctgaggtcgacgtgattattgaagtcatcggcggtgtcgaacagacgaagcaatatcttcttgatgccttgaaagcgaaaaaacatgttgtgaccgcaaataaagatctgatcgccgtatacgggtcagagcttttagccgccgcaaaggaaaatggctgtgacttgtattatgaagcgagtgtcgccggcggaatcccgattttacgcacgctcgaagaaggcctttcctctgaccggatcacaaaaatgatgggaatcgtcaacggaacgacgaacttcatcttaacgaaaatgattaaagaaaaaagcccgtatgaagaagtgctgaaggaagcgcaggatctcggattcgcggaagcggacccgaccgccgatgtagaaggactcgatgccgcacgcaagatggcgattttagcccgtctcggcttctctatgaacgtcgatctggacgatgtcaaggtaaaaggaatttcccggattacggatgaagacatcagcttcagcaaacggctcggctatacgatgaagctgatcggcatcgcccagcgtgatgacaataaaatcgaagtcagcgttcagccgacactgctcccggatcatcatccgctctctgccgtgcataacgagtttaatgccgtttacgtgtacggagaagccgtaggcgaaacgatgttttacggccccggagccggaagcatgccgactgcgacatcagtcgtttccgatctggtcgcggtcatgaaaaacatgcgtctcggcgtaaacggaaacagctttgtcgccccgcagtttgaaagaaatctgaagcagccgtctgatatctacgcccagcagtttttaagaattcatgtcaaagaccaggtgggctctttttcaaaaatcacatcggccttctcagagcgcggcgtcagctttgaaaaaattctgcagctgccgataaaaggacatgacgatctcgcggaaatcgtcatcgtcacgcatcatacatcggaagaagatttcagtgacattctgcaaaacttaaatgatctagaagttgtacaagaagtaaaaagcacatatcgtgtagaagggaacggttggagctaatgtggaaaggactcatccatcaatataaagaatttctgccggtgacggatcggacgccggccctgacattgcatgaaggcaacacgccgctgattcacctcccgaagctttctgaaaagctcggaattgaactgcatgtgaaaacagaaggcgttaatccgacgggatcttttaaagaccgcggcatggtcatggcggtcgccaaagcgaaagaagaaggcaatgataccatcatgtgcgcctcaacaggcaacacatccgctgcggctgccgcatacgcggcgagagccggcatgaaatgcatcgtcatcatcccggacgggaaaatcgccttcggaaagcttgcgcaggccgtcatgtacggtgcggaaatcatcgcgattgacggaaactttgacgacgcgctggccatcgtccggtcgatttgtgaaaaatcaccgattgcattagtgaattcagtaaacccttaccggattgaagggcaaaaaacagcggcctttgaagtatgcgaacagctcggcgaagcgccggacattctggcgatcccggtaggaaatgccgggaatatcacggcctactggaaagggttcaaagaatatcatgagaaaaacggcaccggacttccgaagatgcgcggttttgaagcggaaggttctgcggctatcgtccgcggcgaagtcattaaaaatccagaaaccgttgcgacggcaatccggatcgggaatcctgccagctgggacaaagccgtgctcgctgcggaagaatcagccggaaaaattgatgaagtcacagatggagaaatccttcacgcttatcagctgattgcccgtgaagaaggcgtatttgccgagccgggctcctgtgcatccatcgccggcgttttgaaacaggtgaaatccggtgaaattccaaaaggaagcaaggttgtcgcagttttgaccggaaacggcctgaaagatccgaatacggctgtggacgtatctgacataaaaccgatcacgctgccgacagatgaggacagtattctggaatacttaaatggagcggcgcgtgtatgaatgaggcggagatgctgttttccattacggttccgggaagcaccgccaacttaggacctgggtttgattccatcggaatggcgctcagcagatatttgaagctttcggttttccgaaacgatgaatggcagttctcggcggaaaccgaaactgtcgcgggcatccctcaaggaacggacaacctcatctaccaagtcgccaaacggacggctgaccgctatcagaaagagctgccgcccgcccatgtcaaagtttggagtgacatcccccttgcgcggggtctcggaagcagcgcggccgctatcgtcgccgccattgagcttgcggatgagttatgcggcctgcagctgtcggaaagcgacaagctgcacttagccagtcttgaagaggggcaccctgataatgccgctgcttcccttgcaggagggcttgtaatcggccttcacgaagaagatgaaacacatatcgtgcgtgttgccgaagcggatatcgatgttgtggcagtgattccgttttacgaagttctgaccagggacgcaagagacgtgctcccgaaagagctgccgtaccgacgcgccgttaaagcaagcgccgtcagcaaccttctcgttgctgcgatcatgtcaaatgactgggcgctcgccgggaaaatgatgagaaaagacatcctccatcagccgtaccgcgccatgcttgttcctgagctttcaaaggtggaacacgcggccgaaatgaaaggcgcttacggaacggcgctgagcggagcgggaccgacgattcttgtcctgattgaaaaaggaaagggagaagagctgagaaaacagctttctgagcatttccctcactgtgagattgcggcgcttaccgtcccgtcagaaggaagcgtaattgaacggaatcctttagagcaggtgaaaagtgtataatgataaaaaagcgttcttcccatcagagaaggacgctttctttttctggagaaggatttttatttagggaagcgaaataaaaaagaaaaggaggagatacgattgaaaaaactcataaccgaggaggacattgcgtcactcgtatccgtgacagacccgcaatatgcccctgacggcagaagagccgcttacgtccggacaacagtcaatcataagcgtgattcctattcctcagccattatggtatatgacacagaatccggcatctcaaacccgtggactttcggggacgataaaaatacaagtccgcggtggtcgcctgacggtcggcgcctcgcctttgtttctgacagggaggacggcatccctcagctgtacatcatcgacgctgccggcggagaggcggaacaggctgccgatattccttggggcgtatcagatccgatatgggcgcccgacggcagatccgtgcttgtgtccgtcagtctgacatcagcggagcgcgccgatgagaaagaaaaaaagaagcatgacgagtatgagccggttgagattcaatcattaacatataaacgtgacgggaagggcctgctgaacggaagccggacacagcttgtgctgattcatcttgaaacgggggagattcagcagctgacagatcatgaagctgatcattatggcgcggccttttcaccggatggcaggcagcttgcgtttaccgccaatttatgcgagccgggtgacgccggaaagccgagcgatgtctatctgatgaatctggcggacggaagcctgaagcagattacgccgcaccgcggttctttcggttcctgcgtgttttcaccggacggttcttatatcgcgatgctgggccatgagaatgaatttcgcaatgcgactttagagaaagcgtggctgtacgacgtgaaaactgagcggctgtcctgcctgaccgacatgctggatgttcatttgagcgatgcgctgattgcggattcaatcataggaggagtgacgccccggccggtatggacaaacgacgggcagggcttttacgttctcgggagcgagcagggaagcaccggtatttattatatctcgattgacggcctcgtatatccgatccgattagaagaagagtacgtgaacggttttgcttttcatcctgatcagaaaagctgtatcgctgtcattgccaaacccgcacagccttccgagctttacagcatttcacttgaaaatggggaagagaggcaattgacattttacaatgatcggtttatagaggagcgtatcatatccgtgccggaaaagctgcaatatgaaacaaaggacgggctgacggtaaacggctggtttttaaagccttccgtttttgaagaggatcaaacatatcccctcattctatacatacacggcgggcctcacatgatgtacggccatacgtattttcacgaattccaagtgctggccgcacaaggatatgctgtcgtgtatgtcaacccgagaggaagccacggctacggacaggattttgtcaatcgtgtcaggggtgattacggaggcggagattaccgtgatgtcatgcaggcggtggatgaagccgttcaggcgtatccgtttttagacagcggccgtctcggtgtgacgggcggaagctacggagggtttatgacgaattggattgtcggacagacaggccgttttaaagcagccgtcacgcagcgctccatttcaaattggttcagcttccacggtgtcagcgatatcggcttcttttttaccgactggcagctcggacatgatttgtttgaggaagcggataagctttgggatcgttctcctgtaaaatatgcatcccgcgtttcgacgccgcttttgatcctgcacggtgagcgagatgaccgctgtccgatagagcaggcggagcagctctttaccgcgttgaagaaactgaacaaaacgacgtcgttcatccgatttccgaaagctacgcatgagctgtcgagaagcggccatcccgaacagcggatgaaacgcatccgttatatttgttcatggtttgatgactatttgtaaaaataaaaaaaccaggctgtcatgcagcctggttttatgattaaaatacttgttctacttcaacgacacccggtacttcttcaagaagggcgcgttcaattccggctttcagcgtaatcgttgaacttgggcagctgccgcatgcgccaaggaggcgaagctttacaatgccttcgtctacatcaacaagctcacagtcaccgccgtcacgaagcagaaacggacgtaatttatccaatacttcctgtacttgctctttcatttcaacctcagtcatgagattcgctcctttcatatacataaaaccattatattcacagtaacggtaaaaatctaatgtttggtttgcaaagctgctttctccattatagcatatttaaacttgaacataaaaaccgttttttatacaaaagctgccccgtcctttgtatactggtgtaaaggggatgatatacatgacaaagccggttacgctcagtgtttacggcgctgaaacgctttgcgcaagctgcgtgaatatgccgagcgccaaagatacgtttgaatggctggaggcggcgctgaaacggaaatacccggagcagccttttaacatgcggtatattgatattgaggcaccgcctcagcaaaaggagacagaagagcttgcggagcgcatcaagaacgatgaatttttctatccgctcgtgctggtggaggatgtcattgtgggggaagggaatccgcatttaaaagatatatatgaagaaatggaaaagcgcggctatgtggcgggctcttaaaaatggccgctgatcgcaatcagcggcttttttcttatcagccgttatgatgcttgtacatccataaaaggcctgattttaataaacggggcacacgcccgatgagcggacggtcgttgacaagaccgaagcccgctttttttccgagtgaaccgaggacgcctttcagcttaaattgcggcattgtttccggcagctcttcattgttccagcgtttcaggaggatctgcacaatttgttccgcctgcgcttcagccagctgggcgctcggcgcatgcggcaggctcgcgcaatcaccgacgacgtaaacatgctcatcgcccggaagattgtgatgcggtgttaaaacgatgcggccttgcgggtctttttcagcgtccagttctctgacggctttattcggctgaattcccgccgtccacacgatggcatcggccggtattccttcatcatgattataaacgatgccgtcttccacttttgtaatattcgcattattgataatggtgacgccgtgttcttcaaaccatttctgaacgtacttgctgagtcttttcggaaagcttgataaaatcaggtcgccccggtcaaataacataatcttcagatcgtcacggctctctcttaattcactggcaagctccacgccgcttaatcccgctccgacgatagcgacagatgcattggcgccgaggttgttcagcttttgataggcttcgcgtgactgatcaatggtctgaatgctgtaagtatgttccggcgcgccgggcacgttatgatacttatcctcacagcccagtccgatcaccgcgtcatcgtaagaaatcggttcgcggtcatgaaacagaacctgtttgtttttcgtgtcgatggaagccacctcaccgtattgaacatccagattcggatgctcaggaaaagacaccctgatatgatgatcagaaatcgtgccggctgcgagcgcataatattctgtttttaagcagtgatacgggtttctgtcaatcagcgtgatggatacatctgacggaagctggttcggcagtaagcggtgcagcacccgcatgtttccgtaacccccgccgatcaagaccaattttttcataatgattccccttttgcccgaaaaatatggtagtcaatattgttacaaaataacgaactatgtaaaataacatctagaattatatcgaatttgatctaaaaccacaataatagttttaaaataacctacaaattgaccagaaaacacgcaatagtaaaacctttaacctgaattaatatgttacgataacattgagcgtgaaaccggatctttgacgaatagaggaaattccgttaggataaggtacatatgtgaggtgaaaccgcatgaatccgatgattgaattctgtgtcagcaatttagcgcgcggttcccaggaagcacttgagatcttagagaaggatccgaacttggacgtgcttgagtacggctgtttaagctactgcggaaaatgcatggagtccctgttcgccctggttaacggcgaagtggtcacggggggcacgcctgctgagttggttgacaacatatatacattcatagaagaaaatccgatgttttaatcagaggctccgaacggggtctcttttttattgcgcccgggttttggcaaaataaaaaatttgtagacagcaaaaataaatattgttatcttaataaagactttttttaaataaaattttagaggtggattcattgaatatcgtttgggggctgctcggggcagttgctatattagccattgcttttttgttatcagagaagaaaagcaaaattaacctgcgaaccgtcattgtgggtttatgtttacaaatggccttcggattcatcgtattaaagtgggacgccggccgggccgtatttttatggttctcaagccgtgtgcagcttctcattgattatgcgaacgaaggcatcagctttatttttggcccgctgttaaaagtgggcagcagcccggctttcgcgctgagcgttctgccggtcattatctttttctcagcgctgattgccgttttgtatcacttgaaaatcatgcagctcatctttcgcgtcatcggaggcggactgtcaaaacttcttgggacaagcagaacggaatcgcttgcggcggctgcgaatatttttgtcggacagtctgaatcaccgcttgccattaaaccgctgattgcgggattgacccgttccgagctgtttacgattatgacgagcggcctttcggctgtagcgggttcgacgcttttcggttacgccctgttaggcattccgattgaatacctgctggcggccagctttatggcggctcccgccggtctcgtgttcggaaaaatgttaatacctgaaacagaaaaaacgcagacgataaaaggcgattttaatatggacgaagaaggcgaaggcgccgctaatgtgattgatgcagcggcaaaaggcgcatccacgggccttcagattgctctgaatgtcggcgccatgcttcttgcgtttgtcgcgctcatcgccgtagtgaacggaattctcggcggaatcggcggctggttcggtttcaaacatattacattagaatccattctcggttacgtgttttcaccgatcgcatttgtaatcggcgttccttggcatgaggcgctcggagcgggaagctatatcggacagaaacttgtgctgaatgagtttgtcgcttattcaaacttcggtccgcatattgcggacttttctaaaaaaacgtctacgattatcagctttgcgctgtgcggatttgccaacttctcttcgattgcgattatgctcggcacactgggcggtttggccccaagccgccgttcggacattgcgcgcctcggattaagagcggttattgcgggaacactcgcaaaccttctcagcgcggcgattgccggcatgtttatttagtaaacgataaaagctccctgcatatgcagggagcttttatgtatgaaaaacgggggatatttgtattgtgtccgaggggaagagcttttatactaagtaaaagaaaaaaagttggaggccgatatgaattcattccgttttaccaagatgcacggtcttggaaacagttatatatatgtaaatcaatttgaagaacagctgccggaagaacggctggctgagattgccgttaaagtgtccagcattcacacgggcatcggctctgacggaatgatcctcatctgtccgtcagaaaaagcgccggtcaaaatgcggatttttaataatgacggctcagaagggaaaaattgcggcaacggccttcgctgtgtggcaaagtatgcatacgaacataagctgacagaagaaacgtcctttttcattgagacgctttcaggccttgtgaaagcagatattacggaagaaaacgggattgtgcgtgaagtcgccgtcgatatgggcgaaccgcgcctcaccaaaaaagagctgccgatgctcggcaatgaagatgaacggacgatcgatgaaacctttgtttttggagaaacggagctttccggaacagccgtatcaatgggaaacccccatattgtttttccggttgcggatattaatcaagcgcctcttacaacgctcggtcccgtcattgaaaaagacccgagatttccggaaggcgtcaatgtcgaatttgtggaaaccgtcagcgccgatgaacttcatttccgcgtatgggaacgcggctccggcattacacaggcttgcggaacgggcgcctgtgcggcggctgttgcatccgtattgaacggtgtttccgaacgaaaccgggatatcaccgttcatttagcggggggcgatcttgtgattaattggcaggacaacgggcacgtgctgatgacgggacccgccgaaaccgtatgcagcggcgtctattatttgtaaacagctcgtttgagaaatacgctcctcaaggtttataatagatatcagcatccgtttttaaaaaaggaggtctacttatgagtgttccagtaactattactgaagcagcggctttgcatataaaagatatgatgaaagagcatgaagaagaaaacgcgtttctccgtgtgggcgtaaaaggcggcggctgcagcggcctgtcttacggaatgggatttgagcacgaaaaaggcgaaaaagacagcatgtttgaacagcacgggatcaccgttttggttgacagcgaaagccttgatattatgaccggcacgatcattgacttcaaacagtccatgatgggcggcggtttcaccattgacaacccgaatgccatcgcttcctgcggctgcggatcttctttccgcacggccaaaaacgccggtacgccggaagagtgctaagggtcagcccgccattctcaggatgaaaaaataggacgcctttcttttcgatggcgcttgcaccattgttaaaaaaggcgtttatctgtttaataaaagcaaaacccgctcaacagaagcgggttttgctttttcaaagaggttattcaattgtatgtttcatcgcattgtacatatttgccgtatgttcatcggctttatcccgtgacatgcgcagccgttccgctgaagaaccgtaaccgatttctagtttgccctctttcagtcctttaaaaatcccatcagcgaattcatccagcggttctccttgagtatgcagccctgctccgcctaaatctgtatttaccgccggaggcgcaacttcaatcacttctacagatgaatcagaaagctgatgtctcagactcattgtaaatgaatgaagcgccgctttcgttgctgaatagatcggtgcaatagcaagcggtgtaaaagccaatcccgaagagacgttaatgacagccgcatcttcttttccggcaaaaaacggagcgaacagcatagacaggtggaagggagcttcaatgttcgttgtgatttctttattaaaatagtcccaattgtccttcgcatccgctttcagcacatgaaaacgatgttgaatccccgcgttgtttactaacacattcacttccggataattttctttcacccaatcaaacagtgatacacgttcagatggaatgctcaaatcactgacataggtaataagatccgggaatgtttcctttgctttttgaagagcgtgcttacgccgtccggtcacgatgactttatttcccgcttttaaaaaccgttctgcgaaagccaatcctattccggcatttccgcctgtaatcagtattgtatttcccgtcagtttcatattaactcctcttttccgattgtttttacttcaacaaacttacgtctcttgaacagagcttttgatataagcctttgtcattgacgacatttcatccagtactgaccgcttgtgtctcctcatcatgtcaagccggagtttaataggactctctccttcaattacccaatcaatatattgcttaaagcctttgatggtcatgcgggtattttttaaacaaatcacgatatcaaggagcggcatttgatctgctgaaaataaccgccggctggcttcatcacgttcaatcagcggcagcagtccctttttttcataataacgtaacgttgattctgtcatattacactttgctgctgcttcacgaattgaacaacatgtcttcgaaagacctccaacagtattttttccttgtcactgggtgatgatacgacttaaaccatgttttaagtcaataaaaaaaatgtgatgaattcagacatatgtcacaaaaggaaatgggcagattttcaataggtttaggagtgacggccttcacaaaaatcctcaaatcaacggttcaaatcatactatttgcaaattcggaaaaaaataaagggtatatagaatcaaaaaatctggaagatgtgctcttagtcaacacgttctaaagtcatatttttcgaaaggatattgattttttgataggaataaactaaattgtaaaagtatagaatagttaatttattttgtaagaaaaggatgataatatgataggtcaattgagcaataaaaaaatatttttaagttcttttttcatcattttgatctgttcattactcttccaattcagtatttccgataaagttctgcagtcgtattattcttccgtcggagaaagtacctacgatatcggggagaaaagtgttcgtacgattgtcatgtttctgcaagggtttatgatcttcacaacttttgtggaaattctgataggcggatttctattattcgttgccgcttttattctcggtacaaaaaaaccgaaaaaaatatatttgcttctatatacactgacttctttaatctcggcatttaaaatgttgattctttcagttgttaactacttaacggctgattcctcgcttatatattctgccggcggcaccagcttgagtctgcagctgctggatccatttctgctcatatcaattgcggctctttatgctgccgcaggaaaactgaccgatctcagtaaaggcaagagaatcattttgactggatgttttgttttattaaaactctttactattttctttaattattttatggcggataaaatttagctcgggagagagtcaattaagctgaattttattataaattaaaaaaacagagtagggagatgttatgatgaacttagtaaaatctaataaaaagtctttcattttgtttggcgtggctcttgctgcagcaacattggtttatgcactattattaacgggaactgaattaaacgtggcggcggctcatgcattctcagccaatgctgaattagcttcgactctgggcatctctacagcagcagctaaaaaagcaattgatattattgatgcggcatcaacaattgcttctatcatttctctcatcggtatcgttacaggcgcaggcgcgatttcttatgcaatcgttgcaacagcaaaaacaatgattaagaaatacggcaaaaaatacgcagctgcttggtaaaatcgaccaataaataattgctctttttgtacaagctgcaaaaagagcctctctcccaaatacatatgtaaggattgaaagtatgatagtcaaacaaattgcggctcttatcaaatataataccctgtcatcgtttcgaaaaagaaaggaagattggggcattcctcaactcaacagcaaactgctgtctgccattattatttctctgttatgtttatatctcgttttcctgggatgcggtgttgtattcgggacaaaactgattcagctgcccctcagcgcatgggggcaatttgttttaatcgccgtttcacttgagcagcttttttgggctgccggcttctttaaagaacatcacaatgcctttctgctggatacgcgcaaggtcattcatcaattaaaaaaggtgcgttttttacagctgttttctgtttttgccggccaggcgatcaaaaaaaccattttcgtatggtatctttttgtttttccggtctttttgtttttatcaagcgcaggcatgaccgggtctgcggcgatcatcgtatttttcttgggcttcgtttattttcttctcaatttatttttatctatgctgttttcttatgttgtttatcttcttacaaatatatggagcaaattgttttacttgaaaatcctgaaaggcattttattcagcgtcagcctgctggttccgcttgcagtcgggtatgccgtttatcttctcgtgtttggggagtataccgcaaaggatatttcaagctttacggagtcaccggctttccggaacatcctcatgaatacgccgtatgtatggttagcattccgctcacattccgtgctcgttttcgctgcggtgtttgcggccgccgtccttttaacggcggggatgtttaaactgtggtcggccacgctgaagaaaatggaccttattccttatatgtttttgacaaacgctgattttgcgccaaagctgaaattatatagaaataacaaaatatttcatgccgtttttcaaaaggatctgctgtttttatcgagaattgacgggttttttatcaggaacttcggcagtatgctgtatttgttcatgctgtttttaggtttttgtattccgcttctatcgcatcactttatcgggtattcggcagccgccatcgtgtctgcggcggttatcattgcgaacttttcgtatcagctcgtcggagatgcgctcaaaacagtattatcagttgacggggaaataaaaaatcagcatctgtttcaccggaatatcaaacatgcgtggcagctggtgtttccgaaagtatgtatttataatctcgccgctcttatctattcgttcatcatcaccattttgattacggtgttttttccgtcttccgcggcgctgacgatttacctgtttattgtgtttttatgttcgggttttttatacagtctcgtccagatttcaagcaccgccctgtatcctaagaaaaactgggagcatctgtacgaaattggagaagcggggaaagcaaagacgtataacaacttatacagttctttcattttcattgtgtcgcttcaaatcgctgcgatcacgtcctattttatctataaaaagccggaacttgaaacgatgcttattcattctgcatcaggtatttttgtcctgttcacactattaaactatggagtcatgtttctgtttcttcgcagaatcaatatggcggaaaggtttgcgaacaatgattaaattagtgaatatacaaaaaaactatagtgaaaaacaggtattgaaagatatttcgtttgaggtgaaaaaaggctcaatctatgctttgctggggactaatggagtcgggaaaacaacgactttgaaaatcatttcgggcctgcttaaaccgacttcaggccgcgtcatgattgacggcaaggaactggattcagaagagggggggcaaatatcggctgatatcggttttgtgcccgaccatgcttttttatatgattacttaacgggagtcgaatacttgcgttttacagcggaaatgtttcaagttccgtctcagcggacaaatgattatataaagaatatgttggagacgctgaagctttctcaagacggaaatcagctgattaaaacttattcacatggaatgaaacaaaaattatcaattgcggcagcgctcattcatcagccaaagatattaattcttgacgagccgctgacgggcattgatttaatcagcggtaaaacgatacggacgttattaaaggagtacgtcaagcagggaaatacagtcctgttatcgactcacctgctggagctggcgcattcgctgtgcgatacgatcggtattatacatgaaggcgtttttgcggcggagtatcagtcatccgagcattcattagaagagattgaagaattggctgagcgtatctatacatgatgaaccgcatgttgccggcaatcagaacgtccgccattccgttaaccgcgtcagtgctgtttttttcaggcggtgtgatcgctgcgtttttttccgatcactttgtttcatcagcgtcttacaacggctcgtcaggcgcggttgaactgctgaaaaacaatgcaatcgcttgtctgtttttagccgcgggtttttttacctttgggttgacctcaatcttttatttattcaccaacgggtttattttaagcggctctattatagaaaatctgcatagcggggttcctttttatcagatttttttactgctaattcctcatggtatatttgaagttcctgcgttattattaagtggcgccattggttttaagggcgttgaattggtcatcaggctgtgtttttctaaggaaaaaaagataatggtttcaatgttcaggcatattggaatattggtgctgcttattatttgtctgctgatcgccgctgccgttattgaagcttacatcacaccaatttttaagtaaaaggggcagaaatcatatgagaagtaaattatcattaatcggtgtgccgattgttatgattatcggttatatcatttctttatcctttgagtggctgtttcctgttcttacttttggggtggcaggactatatctctttatatttgctccggtgcaaaataaattcattcgttacatctttttgtttatttttgtgattaatctgttagccagtgcggctctttatttcggtatttaataaaaaaatgacattcaatatgaatgtcatttttttttatcttcgagcggctctgctgcatgttaaaatctgtcgccgttgaaaatagagttttttacgattacatagtcgacattacggatggcttcgagtgtattgccgccggcgtaagagatggaagattgcagatcctgctccatttcaaccagcgtgtcctgcaaagaccctttatgttcgacatgcatttttttgccctcgacgtttttcttttcgcctttttgaaattcagaagcggagccgaaatattctttgtacagctttccgtcgatttcgatcgtttgtcccggtgattcttcgtggccggcgaataatgatccgatcatgaccatagacgcgccgaatcggatggatttcgcgatatcgccgtgcgtgcggatgccgccgtcagcaatgatcggtttgctcgccgcttttgcgcaccagcgaagcgcggctaattgccacccgccggttccgaagccggttttaatttttgtgatgcagactttcccggggccgattcccacttttgtcgcgtcagcgcccgcgcgttccagctcccttacggcttcaggcgtcccgacattccctgcaatgacaaagctttccgggacatgttctttaataaattcaatcatgctgatcacggcattggaatggccgtgcgcgatatcaatggtaatataatccggcaccagctcctgttctttcagctcccggatgaattcatagtcattttccttcacgccgacactgatggaagaaatcagtccgcgcgctttcatatcccggacaaaagccagacgtttttccggctcgaagcggtgcatgatataaaaatacccgttttccgcgagccaggccgcgatgttttcatctataatcgtctgcatgttggccggtacgaccggaagtttaaacgtgtgtccgcccaacgtaactgatgtatcacattcagatcggctttcaacaatgcattttgcaggaatcagctgaatatcttcgtaatcaaatacattttccatatataacacccctaaaagcgaataatatatttaaataaaattaaaatgttcgtctttttataatgtactttgttttgtcaggaatgtcaaatgatttcatgctgcctcatatgcggtcagcttgtcatccatttgcagtttggttatcatagtagtattggttgttgtaagacatttgttacgatagatagatttgcagaagaagggaggggccggtatggaacaaaaacagcccgggcacagcccgaaagcccagaaaattcaggaccggattattttaggcacgatttgggtcgtgtcggcgcttgtcattgcgctcgttgtcggaaccgtcatgaattatatttggatgtttaaataaaaaagagtctgtgccggtatgacacagactcttttttatattatttttcaaacatgcttgtagaatgcagtggctggacgcgcgctttcgggtccatgtaagccttcgcgttgttcacggctgtcggagcttcgccgaaaccgctggcgatcagcttgactttgccttcatatgtgcagatatctccggcggcaaagaagccttcaatattcgtttccatcgtgcttttgacgacgatggaatttttctcgatatcaagaccccagtttttaatcgggccgagagaagaaacaaagccgtagtttacgatcaggtcatcaatttcaatgatttctttacggtcgcctttcacttcttcgagaacgagctgttcgatccggtcttcaccgacaagttcagcgggaacaaacggtgtcagcacgttgactttagaattatgcaggttttcgacactgtgctcatgcgcgcggaatttatcacggcggtggatgatgctgacttctttggcaatcggctcaagcatgagcgcccagtcaacagcggaatcgccgccgcccagaacggcaacgcgtctgcctgcgaattgattgaggtcgtcaatgaagtagtgcaggtttttgccttcatattgttccgctgattccagctcaagctttctcggcttaaatgcgccgtttcccgcggtgataatgaccgtttttgaataatgcgtttctgaattcgtgacaagcttaaacacaccgtccgcctgtttttcaacagattcaacggcctgctctaagcagatggtctgatcgaactttgccatttgctcttttaagttgttcacaagttcctgggcgcggattttcgggaatccggctacatcataaatatatttttcagggtacagcgcgctgagctggccgccaagctgaggcaggctctcgatgattttgacgctcgcctgtctcattcccccgtaaaaagcggtaaacaggccgaccggaccgccgccgatgaccgtaatatcataaacctttgaatcctcttgcataccaaattgcctcctaattgaaaattgttattaattataacatacaatttgaaaggatgacgagtgccgaaaaccgcccggccgcttcattcttgaaaaaaattgcggccgccgctaagatggggacaaattccaatctgttttttcctgaatgttttccgattcttccggatagtatggtgatatgcagacatgtgcggttttctaaaaaattttatatttcatttcataaaatcccgccaataagctgaagctaatacaaatgttgatttgattatgcgtctaacagcaaaaaaaagaaggtggatgtgatggcattgaataaacccaaaatcgtggttttaggtgcaggttatggtggattaatgacagtaacaaggcttccgaagcatatcggggcaaatgacgccgacattactttggtcaataaacacaattatcattatgaaacgacatggatgcatgaagcgagcgcaggaacgctgcatcatgaccgctgcagatatcaaataaaagatgtaatcaatgaatcacgggtcaaatttgtgcaggataccgtaaaagcgatagatgtgcaaaataaaaaggtgacgctttcacaaggggacatcccttatgattatctcgtcatcgggcttggcgccgtccctgaaacattcgggattaaaggtttaaaagaattcgcttttccgatcgcgaatattaatacgtcgcgccagctgaaagaccatattgagctccaatttgcgacatacaatacggaggccgaaaaacgccctgaccgcttaaccatcgttgtcggcggagcgggctttacgggaattgaatttctcggtgaacttgcgaaccgcaagccggagttatgcagatattatgatatagatgaaagtctcgtccggatcgtctgtgtcgaggccgccccgacggttttgccgggatttgatccggagcttgtcgattacgccgttcaataccttgagagcaaaggcgttgaatttaaaatcggcaccgcggttcaagaatgccgcgcagacggtgtcacagtcggcaagaaagatgaagagccggaagaaatcaaatcgcagaccgttgtctgggccgcgggtgtgcgcggacatccgatcgtggaggaagcgggttttgaaaatatgcgcggccgtgtcaaagtcaaccctgatcttcgggcgccgggacatgatgacgtttttattctcggcgacagctcgctctttatcaatgaagagacggaacggccgtacccgccgactgctcagatcgcgatgcagcaaggagaaacggtcgccaaaaatctgggcggtttgataaaaggaggccagcttgaagagttcaagcctgacattaaaggaacggtcgcctccctcggtgagcataacgccgtcggagtcgtatacggcaggaagcttaaaggcacgccggcgtcctttatgaaaaaggtcattgataaccgctcgctctttatgatcggcgggctgggcctgacgctgaaaaaagggaagtttaaattcttctgaaaacccgcagccgcgggttttctcttcttttaaaaaagagcgctataaaaagcatgtaaaagaaaaaaaagaatgtttccgcttacatgagttgttatgttacatattctgacttggtgcttgacaagtaaatatgatatattatcagaaaattaagaaaaagggtgatccgcatgaaaacgacagcaaaaagcacggcggcgtgtccgttctgctcaggtaaagggtattttcaattgcttcttggcggctccgaaacatgtccctcctgccagggaagcggcaaagagagacgctgatttttccagacgttgacttttttaccgcccccgaggtacactgaaagtgctgtagggggtggatgtttgtgattagtttgccggttgtcctgatctcaatcgtactattttttgtactgtttttcggcataggctttctgttgaacatgctgcttagaatgtcgtggattatggctgttgtctatccgattgtatgccttttcattatcagcaataaaaagatgatcagttacgtgcaggcgccgggggaatcctttcaaagcctgtttcagcgcatcatgtcattagcggttgcggatgtcgtgattttggcgggcggactggcgggagccatcatgtcaggcattgccataaaggcgctcagaaaaagaggatatcaaatgttttaaaccgctttcttattcaagaaagctttttttgtgtcacggcgctttttgtatagcacctcaccgagttgggaacaatgactcggaggagagtgatttcagattgacgataatcagacgcgtattcatgatcgtgctctttttgggcgcatgccatgcgacatacttttctataaccggtgttgaagcaaaggatctgacaaattggatgacggaacatcgcggcgccgttttgaaaaacatcggcactccgtttcaatccttacagaatcagccggaaaagaaggcatcaggcagggtaaagccgctggaagaagcttttgactgggaacgctatccgtcacaaaaagtgacggccaccggttataccgccggagcggaatctaccggaaaatctccgggtcatccgcagtacggaattacatattcaggtgtgaaggtcaaacgcgatttatattcaactgttgcggccgatccgtctgttttcccgatcgggacgattctgtttataccgaattacggttacggggttgtcgccgataccggctcaaaaattaaaggcagccgccttgacctctactttgacaccgtcaaggacgtctataacaattggggcaaaaaaacacttgaggtctacattattaaaaaagggaacggcacagtgaccgaggacgaacttgtaaagctgaacgaaacaaagtcgctgcaagtgttcagaaatcaatacaaaacggtaaaagaataaaaacgcttcagcatccgctgaagcgtttttacataaagaaataatctaaaatcaatgtcagcacaataccggtgacgccgccgaagaacacttcaatcggctgatggccgagcagttctttcagtttcttctgtttttctttctcttccgctttctgaaagtccttcgcttcgctgacaaaccgattaaagtcgatgaccagtttattaatgactgtcgcctgttcacccgcatgccgcctgacacctgtagcatcgaacatcgtaatgacggcgaaaatcgcggcgactgcaaacaggggcgagtccagtccctgttccaaagcgattccggttgacagcgcggtgacggcggcggaatgggagctcggcatgccgccggtgctcgtcacaagagaccagtcaagttttttggatacgataaattgaataggcacttttacaacttgggcaaaaataatggcggcaaaactcgccagtaaaggaaaattcataagtacatccatatgcgacatcctttctgtatctgctgattccgatcgtatcgaaaaactgcagaaaacgcccttagtttggtaaaataaaatcaatgaaaaatgttttttcattataccactttacataacaaatacccacataaggagtgtgtactcatgttttatgcatctgatcaactgcggcatcccgaaacactggtcatcggtctttttcaaaaaagcacgctgaacggatttacgaaggaattggatgataaattagacggtcatctgacccagctgttaaaggatggtgatgtgtccgccaaacgcaatcgtgtatcaaaagtataccctccggctgcgaccggtatgaaacgtatttattttatcggcctgggaagagaagcggattattcgtttgaagatacgaaagaatgctttgcacgagtatttcagcagattcatcaagataaaaaacaggaagtatccgtgttgctcgatacattcgtctccggggaagtgcctgccgccgatgccgctcatgcgctttcggaaagctgtctgcttgcggtttatgaggtgcaggattataaacataaatcgaatgagccggatcaggaactgaaatcagtctgcgccgtgaccgaagaagacctgagggaagtgcaggccggcctgaacgtcggcgcggcatacggccaagggacgaattcagcccgcacgcttgtgaatatgccgggtaatatgctgacggccactgatttggcgtcatatgccgctgagcttgcggcaaaatacgatttcgagtgtgaaattttagaaaaagatgaaatggaagagctcggcatgggcgggctgcttgccgttaacaaaggctcatccgaaccgccgaaaatgatcgttctgaagtatcagggcaaagatcagtgggaagacgtcatcggcctggtcggtaaaggaattacctttgatacgggcggatattcaattaagccgaaaaccggcatcgtcggcatgaaaagcgatatgggaggggccgcctcggtattgggcgcaatggaaattatcggcgaactccggcctgaacaaaacgtgctcgccgtcataccgtctacggacaacatgatttcgtccgatgctatgaagccggatgacgtcatcgtttcgctcagcggaaaaaccattgagatcctgaacaccgatgcggaagggcgtctcgtgcttgccgacggcatcacatacgccaagcagcacggagcctctgtccttgtagacgtcgcaacgttaacgggcggtgtcattgtcgccttaggtaacgaaatgacgggcgccatgaccaatcacgccgcgttttatgaacaggtggcggaatcggcgaaagaatccggcgagccgatctggcagcttccgattacagaaaaggataaaaaacgggtgagaaacagtcagatggctgatttgaacaattctccgggaagagaaggccacgcgattatggcgggggcattccttggtgaattcgcggaaaacacgccgtgggttcatctcgatattgcgggaaccgcgacggcgaataaagcgacatgcttcggccctgccggcgcaacaggcgtcatggcaaggacgttggctgttttgactgagcggtttacgcccgaaagataacagcatcccgctgccttgatgcagcgggttttttgatttccaaaatctttagttgactaaagcgcagaatgtatgttaactttaattatctactacattagcaaactaaaggatttttggagggactcatcaatgaatgctgttgttgtcgcagtattgcttatgctcgtcttaagcctgctgcgtgtcaatattattatagctttaatgatcggcgcgcttgccggcgggctgaccggcggcttaggcctcggagagacggtgaaggcttttacggacggtctcggcggaaatgccaccgtcgcggtcagctacgcgctgctcggagcatttgccgcggcgctgacgaagacggggcttcccgatgcaatggtggaagcgtctgtcaaactaatcggaaaaaaggaagattcgcggaaaaaagcactgtcaaaagtgttaatcgtactggttattttaatcatatcctgtttctcgcaaaacgtggtgcccgttcacattgcgtttattcctgtattgattccgccgcttttaaaaatatttaacgaacttgaaatagaccgcaggctgatcgcgtgtgtgatgacattcggactgactgcgccgtatatcgttctgcctgtcggattcggacagattttccaggggatgctgagagataatatggcgtcagccggtttaaaggtgccgctcagtgatattccgtatgctttaatcatcccgacggccgggatggtagtcggtttaattttatccgtcatcgtcttccggaaaccgaagaaatatgagacgaaggagattgccggactgtcgtcttctccttatacgaaaaaaagcattgccatcgccctgatctccattgccgtgtcgcttgccgttcagctctatctgtcacaagtgctcggagtggaaggtatgatcatgggcgcgcttgccggcttgtttacgctgtttatcagcggagtcatgaagcgcaatgaagcggataagctgatcacggacggcatgattctgatggcttttatcgggtttgtcatgcttgttgcggccggtttttcaaatgtattgaacaaaacgggcgatgtggcttccttggtcaaagcatcaacaggctttatcggtcacagtcaatcattaggcgcgctcctgatgctggtggtcggtttattaatcacgatgggaatcggatcatcatttgcaaccgtacccgtcattacgaccatatttgtcccgctgtgcgctcagctcggattcagcccgatggcgacgatcgccgtaatcggagcggccgccgcggtcggtgatgcgggttctcctgcaagtgacagtacgctcgggccgacgtcaggcctcagcgccgacggacagcaccaccacatttgggatacgtgcgtaccgacatttattttctataacattccgcttgtgatattcggctggattgccgcgcttgtcctgtaaaaaaaggctcccggaaaggggagcctttttgtatgctgagaacatcttacgccggatttctgctgaaccccgtcgctttatgaatagacctgtatacggcaggcgcgattgatgccaataacagtgctaaaacgatatcttttatgaaaaaccatatcatgtaaaaccaggccattccgtagctgatcggagcatgaagccataatttcagcgcaatatacgtataggtcgtgccaatgatataaatgacggcggtaccgatcaaagaggcccatgcataatgcaggcggccgggtttttttgttttttccagcagccatccggctgcaaatgccgccgggatgtaagcgagaataaacccgccgctctttccgataaacggcgcaaagcctgctgagaattgagcgaaaacaggcgcccccgcgagtccggccaatgcgtataccgtcattgcaatggctgcccgtctggcgccgagaagcatcgcggctaacagacaaaagaaaggctgcagcgataacggaattcccgcaacttgcaaaaaaggagccattgatgtaatgttggcgccgacggccatcagggcggcaaacatgccgatcagcgccatatcgcccgcgcgaaggttgcgttgtgtcatttgtttttcccccttacacttgtaccagattagcgtaatcgaagggtgattgattgtcaacaaagatttaatacaggtttactaaatggagggagccatatgtttttcgggaaaacgaaacaaacaaaacagtcggaacggattccgccaaatcaaaatgtcacaacgaagtttcccgtgcttcacgccggaaatgttccttattatgaagatatgtcaaaatggaatctgcaagtgtacgggcttgttgaccgtcctatgctgttaagctttaaagatatcaaagcctttccggaagccgaagtgaaaaatgatattcattgcgtcacgggctggtcccgtcttgataatatctggcagggaatacgcgccaaagacatcgctgagaaagcgggtgtgcacaaagaagcgggattcgtcattctgcacgctgaagagggctggacggccaacctgccgctttctgattttacgcgggaaacatccctgctggcatatgcgcataacggcgagccgttaacgccagagcacggctatccgctcagaggcgttttcccccatctttatttctggaaaagcgcaaaatggctgcgcggcattcagtttacaaaggaaaaccaccccggcttttgggagaaaaacggctaccatatgaggggagatccatggaagaatgagcgctttacatgggattaagcccctatccctatatagttcttaggtaccttattaaaataaggtgctttttttatatcaaaaatccattgactttgtttggcaaaaaacctattatttgaggtgtcttttgatattgaaaatcattatcaatgaggatagataaagtaattgccacaaaggggatgaacacataatggacggaaaacaaataaaccgggggttcgcgccggccggccgatacgcggttccgggcacagaagtaagagaaatgcgctcaaaaggaggccgtacgtatcgtatctttgtctcttttcctcaggaagaaccgcctgcctccggcttccccgtcatctacctgcttgatgcaaattccgtgttcggtacaatggccgaagctttgcgggtgcaaagccggcggcctgaaaaaacaggcgttgttccggcggtgattgtcggaatcggctacccgacagatcagccgttttccgccgaacggcacagtgattttacgatgccgctttctgaatcagaactgccggtgcatccgcgcggcgcggcatggcccgaacagggaggggcggaagcgtttctggagtttatagaagaagaagtaaagcccgcgatggagcgggattatccgatcgacagagacaggcagacgattttcggccattcgctgggcggtctttttgtgctgcaagtgcttttgacgaggccggacatgttccagacctatgttgcgggaagtccgtcaattcattggaacaagcgttttattcaggaaaacgcagaacgtttgtcagaccggctctctgcggaaaatcttcaagtcagtgtattgctggctgcgggagaaattgaaaaaacacataaaagcagaatcccgcagcacgcagaggcgctgtactctttattatccggatttgaagatgatggagtccgtgctgaatacagcgagtttgaaggagagggccatatttctgtcctgcccgttttaatcagcagagccctgcgtttctgcctgaatccgggagggccgcataccccgtattctcccacatgagaaaaaacaggcccttcgaactaaatgcggctgattctaattttctaattgactgcgtgttttgatttggatatgattgtcttgaatcataattgataatgataatcattatcaatatagaaagggaatgataatatggacgcattgggaatgaaagggaaaacggccgttgtcaccggcgccgctcaaggcatcggagaagcaacagcgcttgcccttgctgaacaaggcgtaaatgtggcagctatagatacaaatgaagacctgcttcccgggctaactgacagacttcggcaaaaaggcgtgcaggcgcaggggtttgccgcagatgtatctgacagtgcggctgtcaatgatatcatcgctgccgttgaacgtgacatggggcctattgaaatattggcgaacgttgcgggcgtgctgcggccgggtccggtgcaatcccttagtgatgaagattgggatcaaacattttctgttaatacgaccggcgtatttcatgtatcgcgggctgtaagccggtacatgattgagcgtcaaaaaggcgccatcgttacggtcggttcgaatgcagccggcgttccgcgtgcttccatggcggcttatgcggcgtcaaaagcggctgccgccatgtttacgaaatgcctcggactggagcttgcggcccatcatatccgctgcaacatcgtatctccgggttcaacggaaaccgacatgcagcgggcgctgtggcgggatgaaaacggagcacaggacgttatcagaggttcgcttgatacatataaaacgggaattccgcttcaaaagctggcaaagccttctgatattgcaaatgccgttttgtttctggcctctgaacaggcaagccatatcacgatgcatgatttatgcgtggatggcggcgctactttaggcgtttgatttaacgagaaggagggacaaacatgacaaatcaacatgtattgacggaagtgtctgcaaaagaggtgctggacgcttacaagcccggagcgttctttttagcttccccgaaaaggacgctccttgcagaaggtgtgtttgcaaaagtgccggatgcagacgcggagaatcagctggattcactgcctgaacgcgtaagacagacgcttcttgaggcaaagcaagccggcatcaaacatccgattgcggccggcgccattccttttgacggcagaaaagcttcccggctttttgtaccgaagaatgtccatacggcaggcccgctttcgtttgcggaatcttccgcagaaaagccgcaatccaatacatatgacatccgtcccgttccggagcctgagggctttatgagcggtgtggaacaaggcgtattcaacattacggacggcccgctcagcaaaatcgtgctgtcaaggacgcttcatctgaccgctgaaaaggatatcgacattcctcaggccgtcaagcatttggcgcagcacaacccgcgcggctatacattcgcttcggatgtgacgggaacgtcagaaacaagaaaaacgcttttcggcgcaagtcctgaactgctgctgtccaaaaacggaacatcgattctgtccaatccgctggcaggttccagacctcgcagcacagatcccgccgaggatcagagaagagcggaagaactgctgcaatcagcaaaagatctgcatgaacatgccgtagtcgtggccgccgtggccgccgccctaaaaccgttctgccgtgtgcttgatgtgccggaaaaaccgtcactcattaaaactgaggcgatgtggcacctgtccaccgaggtaaagggagagcttagtgatccgtcaacgacatcgcttgagctggccatcgctcttcatccgacgcccgctgtatgcggaacgccgacggatgcggcgagagaagcgattcaggatatagagccgtttgaccgcaatttctacacgggaatggcgggctggtgtgatgctgaaggtgacggagaatggattatcgcacttcgctgcgccgaagcggaaacaaggtctctccggctctttgcgggtgccgggattgtcgccggatcaaagccgcaggatgaactggacgagacatcggcgaaattccgcaccatgctccgggcgatggggctttaccaagatgagttgtaaaaaaggagggaacggatcgtgctgactggatttacgccatggccggaagaatgggctgaaaaataccgaaaagacggctgctggaagggtgagacgttcggaggaatgctgaaagagcgcgcggctttatacggaaatcaaactgccgtgacgtgtaaagatgtacattggacctacaaagaattagatgaaagggccgatcgtttagcggcggggctgcataagctcggaattcaaaaggaagaccgcgttgtcgttcagctgccgaatatcgctgagttttttgaagtgattttcgcgctgttccgactcggagcactgcccgttttcgcgctgccttctcatagaagcagtgagattacgtatttctgcgagtttgcagaggcgaaagcatacatcattcctgatacgcattcaggttttgattacagggcgcttgccagacaggtgaaagacaaacttccggatttggcgcatgtcattgtggccggcgaagctgaagagtttcaggaactgagcagcctgcatagagagcctgttcagctggaagaggtaagcccggcggaagtcgcttttttacagctttcaggaggcagtacggggctgtccaagctgattccgcgaacacacgacgattacatatacagtttgcgcctcagcgcggaaatatgcggcttggatcatcacagcgtttatttggccgctctgccgacagcgcataattatccgctcagctcgccgggtgtgctgggaactttatatgccggaggccgtgttgttctgtcaccgacgccgagtccggatgactgcttcccgttaattgaaaaagaacgtgtcacgattacagcgctcgtcccgccgcttgcgatggtgtggatggacgcatccggttcgcgaagtgatgatttatcaagccttcaagtgctgcaggtgggaggcgccaaattcagtgctgaggcggcccgccgcgtaaagagcgctttcggatgcacccttcagcaggttttcggaatggcggaaggattggtgaattatacgagactggatgatcctgaagagatcattgtcaatacgcaaggcagaccgatgtcaccttttgatgaggtaagggttttagacgatgacgggcgggatgtcgcccccggagaagcgggacatttgtttacacgcggcccttacacgattcgcgggtattataaagcgcctgaacataatgaaagatcattcacagccgacggattttatcagaccggcgatatcgtcaaactgacggcggacggctatatcatcgttgaaggacgtgcgaaagatcaaatcaatcggggcggcgaaaagattgccgctgaagaggtggaaaatcaccttctggcccatcctgccgttcatgatgcggccatggtttcaatgccggatgattttctcggagagcggtcctgtgtgttcgtcattccgaaaggagaagcgccgaaaccgggagagctgaaagcgtttttacgggagcgcgggctggcggcatataaaattcccgaccgggttgaatttatcgcttctttcccgaaaaccggcgtcggcaaggtcagcaaaaaggaccttcgcgaaacgatcgcccaaaaattgaagcctgctgaaatcaaacaatcttaaaaaaggaagtgtttacattggctataccgtcaattcccgcatatgcgctgccgacagcgtcagatatgcctgaaaataaagtatcgtggacgctgaacccgaaacgcgcggtgcttctgatccatgacatgcagaattatttcgtcgatgcttttgagaaagggaaggctccgatcacggaggcggctcagaatatcaagaaaataaaagagcaatgcaaagcgctcggcattccggtggtgtacaccgcgcagccgggcagccaagacccggcggaccgcgcgctgctgacggatttttggggaccggggctgaaaagcgggccttatgaagaaaaggtcattccggagcttgccccggatgatcaggacattgtcctcacaaagtggagatacagcgcgtttaaacggacgaatctccttgacatcatgcgtgaaagcggcagagaccagctcatgattacgggaatttatgcacacatcggctgtctcgtcacagcctgtgaagcatttatggatgatatccaaagcttctttatcggagacgccgttgctgatttttcttcagaaaaacataagatggccatcgaatatgcgtctcagcgctgcgcttacacggctttgacaaacgaagtgctggagctgctgggcggcgcgccggtttctgaaggagaagggaagacttccgccgtattgacaaaagaccgggtgcgggaacaaattgcggcgattcttcaagaatcaccgtctgatattccggatcatgaagacctgctggacagaggccttgattccgtcagaatcatgagccttgtcgaacaatggcgccgtgacggagctgaagtgacgtttgttgaactggcggagaacccgacgcttgaagagtggtggagacttctttcttcccgatctcaaaaagtcttgccgaacgcagattatttataaagggagagaatagaatgcatgatacacaacagctgcctctgacaggcgcacaggccggtatctggtttgcgcagcagcttgatcctgataatgcgatttacaatacaggcgagtatgttgagataaacggcgcgatcgatgtgaacatatttaaaacagctctcgaacgtgtgctgacggaagccgtgtcattacacgcccgcttcgaagagggagcagacgggccgaagcagatcatcaatcctccatttgaagctgcgatcgatgtcatagatgtgagttcagaagctgatccgaagcaggccgcactcagactcatgcagacagatttggctgagcccgttgatatggcggccgggcctttgttccgcgacattttatttcaggcgggaccggaacgctttttctggtatcagcgcattcaccacattgcgatagacggctacggtttttcactgctggcacggcgtacggcgcaaatatacaccgcaatacgggaaggacgtccggataacgggcgctccttcggctctttggaggaactggtaaaagaagatcaagaataccgcgcgtctgatcaattcctgaaagatcgggaattttggatggagaaatttgcggatgaacctgatgtcgtcagtttggcagaaagagcgccgagaacgtcaacaagctttcggagaagcacggcttatctttctgaaacggctttgcagcatgtaaaagcaattccgaactggcatgaagccgtcacagctgcagcggcggtatatgtccaccggatgacaaacgcaggggatatcgtgctcggtttaccgatgatgggacggatcggctcgatttcactgaatattccgagtatggtcatgaatcttctgcctttacggctttctctccgcccggatatgaattttcatgaggccgtcagccaagtggcaaaagaaatccgaaacatccggcgccatcagaaataccgccatgaagacatgcgccgcgatcttaaattgctcggagaaaaccgcaggctgttcggcccgcaagtcaatgtgatgccgtttgactacgctcttgatttcgcaggagcgccaggcaccgtccataacttatcagccgggcccgttgatgatttgtcaattaacgtttacgacagagcggacggaagcggaatgcgtgtggactttgatgcgaatccggaagtgtacagcgccgaagatattgaaaaccatcaaaaacgattcctgcttctgctggaatccgctgtgaaagaccagacacaaaaaatcggcacactcaaccttctgcctgaaagtgaacgtctctgcgtactggaaagctggaatgacacgcgcaaggccgagaagcagaaaagtctgccggagctgttttacgaacaggccgtaaaaacaccggaccggccggcaatcatcaccgaaaacgaagagctcagctatgccgaattgaacaagcgcgcgaaccagcttgccggcatgctaaaggaaaaggggctcggaccggaacaatttgccgctttgctgcttccgcggtcacaggagttggccgtgagcatgctggccgttttgaaaacgggagccgcatacctgccgcttgatcctgattttccttctgagcggatcacatacatgctcaaagatgcacaccctgcatgcctgattacaacgatggaattatccggccgcatgccggaagacagtgatgcaaaaaggatcattctcgatgacccggatacggtaaaaaccgttgccgctcaaaatgctgactgttccgatcaggcggaatgttcgcctttgcaccccgcttatgtcatatatacatcgggttcaacgggcaaaccgaaaggcgtagtcgtgacattaaaaagcgtaagcaatttcctcttatccatgcgggaaatgttcccgctcggcgcacaagaccgcctgcttgccgttacgactgcggcgtttgatatttccggacttgagctcttccttccgctcatcagcggggcggggtgcgtcatcgcacgtaaagagacgattcaggaaccgcgggcgcttgcgaacatgattcactcatacggtatttcaatcatgcaggcaacgccgacattgtggcattcattagtcaccaatgaacctgattccctccgggcgctgcaggtgcttgtcggaggtgaggcgcttccgaacgcgcttatgcatgctctgcttgaatcaggctgtacggtgacgaatctgtacgggccgactgaaacaacaatctggtcggccgcacagccgcttgcaaaagaccatacaggggcgcctccgatcggaaagccgatttggaacacgcgggtatacgtgctggacgccgcattgcagccagtcccgccgggaattgcgggcgagctttatatagcgggcgaggggcttgccagaggttattataaccgtcctgatttaacagctgaaagatttattgccgatccgtacgggcccgcgggcgcgaggatgtaccggacgggagatctcgtgcgctggcgtgaggacggctcgcttgattatatcagcagagccgatcaccaaattaaaatccgcgggttccggatagaattaggagaaattgagtcagtgctgtcgaaatacccgggtatttcgcaggccgctgttattgtccgtgaagaccagccgggagataagcgcctggcggcttatgctgtcgcggatcagccccttgatatcggcggacttcgtgaatatatgggcgaaagcctgccggattatatggtgccgggcgcgtttgtacagctgaaagaattgccgctgacgccgaataagaagctcgatcgcagcgctctgcctgcacctgatttttcagctgtcctgtctgacagagggccgcggacgccgcaggaagaaatattatgcgatctgtttgccgaggttctcggtctcgcgcgggtcggaattgatgacgggttctttgaattgggcggacattcgctcttagccggacgcctgatgagccggatccgggagacgatgggcgcagagcttggcatcggacgtctgtttgataccccgaccgttgccgggctcgccgcacagcttgacaccgcaaagagtgcgcggcctaagctcaagccgtttgaccggccggagcacatcccgctgtcatttgcgcagctgcgtctttggtttctctactgtcttgaagggccgagcccgacttacaacattccggtgattgtccgcatgtcaggcaagcttgaccaatcagcgctgaaacacgccttttacgatgttgtcagccgtcatgaaagcctgcgcaccgtttttccggaaaataagggatcatctcatcagcttattttacctgctgaagaagcccgccctgtgtttacagtgacacgtgcagacaaaaacgagctccaagacatgcttgccgctgcggcaagatatcggtttgatctcgctaaagagccggccgtccgggctgagctgtttgatcttggtgacggcgaatatacgctgatggttctcctgcatcacatcgcaggcgacggctggtccttgaatccgctcatgcgtgacttatccatagcctatatcgcccggcaaacaggtgaaaaagcagaatgggcgccgctggcggttcaatatgcggattatgcgctttggcagcagcagcttttaggcagcgcgtctgattctgagagcttaattgcgcgccagctggatttctggaagaaaacgcttgaaaatgtaccggatcagctggagctgccgtctgattttccgcgtcccgctgaatcaagctacaggggcggcgtcattccggtcaacatcggccaagagcttcatgcccgtcttctctcacttgccagaaatcagcgcgtaagcctgtttatggtgcttcaatcagggctttccgcactgctgacccggctcggggcgggaaccgatattccgatcggcagtccgatagccggccgcagtgatgacgcattaggagaccttgtgggtatgttcattaatacactcgtactgagaaccgatacctctggcgatccgagcttttgtgagcttcttgaaagggtcagggaaatgaatctcgcagcatatgaacatcaggacgtgccgtttgaacgtctcgtggaagaattgaatccggttcgctcccggtcaagacatccgctgttccaagtgatgctcgcattccaaaatacgcctgaccctgtactcagtcttcctgatatggaaacaagcctgcaaatcagcagtgtcggatcgtccaaatttgatttgacattggaattggctgaacagcgccatgatgacggcacgcctgccggtattgaaggcctgctggagttcagtacggacttattcagaaaagaaacggctgaagcacttgccggacgcctgcttcttctgctcgaagatgccgtatcacatccggataaaccgatcggaagcttaaccattctttctgatgaagagcgccggaagcttttgccggttaaacgggcaaaacagcatattcagcctcggcagacactgcctgaactgtttgaaatacaggccgccgcaaaatcggatgaaacggcggcagtatttgaagagagcggactcacttatcaagagctgaataaaagagccaatcagctcgcgcacatgatgattgcccgcggcgtcggcccggagcagtttgtcgcactggcgctgccgcgttctttagatatgattgtcgggctgttagccgtcctgaagacgggggcagcgtatttgccgcttgatcctgattatcccgcggaccgcatcgcttttatgttacatgatgccaagcctgtatttatgctcaccaaccgtgaaggcgcaagtaagctctctggcgaaaacggcatgccggccttcatcctggatgatccgcagaataaggaaacacttcggcaatatgccgtcacgaaccctgagaatgccgaccggattcgtccgctgagaccgcttcacccggcctatgtcatttacacgtcgggatcaacaggtgtgccgaaaggtgtcatcattccgcacagcaatgttatccggctgtttgagtcgacgcggcattggtatcactttaattctgatgatgtatggacgatgtttcactcctacgcttttgatttctctgtctgggaaatatgggggccgctgctccacggcggacgtctcgtcgtcgtgccgcatgacatcagcagatccccggaagcgtttctgcatcttctcgtgaaagagcgagtgaccgtacttaaccaaacgccgtcagcgttttaccagctgatgcatgcggaaaaagaacacaaagagctggggcatcagctcgcactcagatatatcatcttcggcggcgaggcgcttgagctgagccggcttgaggattggtacagccgccacgcggacaatcagccggtgctcgtgaatatgtacggcattacggaaacgacggtgcacgtcagttaccttgaattagacaaaaacattgccgaactgagagcaaacagcctcatcggctgcggcattcctgatctgaacgtatatgtgcttgatgaccggctggagcctgtgcctccggggatcacgggcgaaatgtatgttgccggagggggcgtggcacgaggctacttagggcggcaaagcctgaccgccgaacgctttgtggctgatccgtacggcccgccgggaacgagaatgtaccggacgggggatttagcccgcctgcggacggacggttctcttgattatatgggcagggcggaccaccagattaaaatccgcggcttccggattgaattgggggaaatcgaagcggttctcgtcaaacatccggatgtcgaggatgccgccgcagtcgtccgtgaagaccggccgggagataaacggctggccgcctaccttgtccgatctgccggcagcaccttggacacgggggacatgcgccggtttgccgaagaaagcctgccggattacatgattccatcagcttttgtccaaatgaatgaactgccgctgacaccgaatggaaagcttgaccgaaaagcgctccctgcgcctgacttccaaacggaggtcaccggccggggaccgagaacgccgcaggaagaaatgctgtgtgagctgttcgcagaggtgcttcatctgccgcgtgtcggtattgatgacagattttttgatttaggcggccattctttgcttgcggttcatttaatgagccgtattcgggaagcgatgggagccgagctcagtatcggaacactatttgaagctcctacggtggcaagccttgctgaaagacttgagtcaggaacgggcacaagcgcgcttgatgttcttcttccgctcagaacggcaggagaagaaacaccgttgttctgtgtccatccggccggcggtctcagctggtgttatgccgggctgatgtcttctttagaagctgattatccgatatacggcttacaggcgagaggcatcggaaaaaaagaaccgcttccgcaaagcttagatgacatggcggctgattatattgaaaaaatccgcaccgtgcagccgaaagggccgtaccgtctgctcggctggtctctcggagggaatgtcattcaggccatggcgacacaattacagagccggggcgaagaggtttcgcttttggtgatgcttgacgcgtatccgaatcattttctgccgataaaaaatgcgcctgatgacgaggaagccgtcattgcgctgcttgccctgggagggtacgacccggacagcctcggggatcagccgcttgattttgacaccgcgctgaccattctccgccgtgagggaagcgcattagccagcctggacgagtcagtgatgatgaatctgaaagacacgtacgtaaattctgtcgggctgttaggaacatacaagccaaagccgttccacggagatgtgctgttcttcagatccacgattattccggagtggtttgacccgatcgagccggatacttggaaaccgtatattactgggaaaatcgagcggtatgacttagactgccgccataaagatatgtgccagccgggcccgcttgccgacatcggcgcgattctggcagagaaattaaacggacggcgtacagtccggtaaagaaaggaaagagatgatatgacaaatccatttgaacgggaagacggttcataccatgtgctcgtcaatgctgaaggccagtactcactgtggccggcctatctggatgtgccggacggctgggaaacccgcctgacgaatgaaacccgccccgtttgtctcgaatatattgaaacaaactggcgtgatatgaggccggaaagcctgaagcggaccgaagctgctaaaatgtaataagaaaagcctgccgttatttcggcaggctttttatgcggacatcagccgttaagctgtgtatgatcacaaaatgtataagggtggccttcttcatccgtgcaccatgactgagacagaaaagccaaaaagaccgcggcccactggtctgcaaactggattaaaataccgccgtcgtgccacgttccgttatccttcttccagcgtgtatcaattgggtttccctgattcatatgaatattatgcatgccgtttgtcggcttgaacccgaaaatcttatcagcgcccggctccggcccgaatttagagccgtaaatatagacggtggctttttctgatttggctttttgcatgtacgtctcaataaagtcatttaagtcattatccggaccggtgacttcatgcggaaggggcaccatgttccggggatcaaacaatccgccgcggacataatccagcgccagctcacgtctggtttcatcaattggggtatatccgtacggaatgttcggcagcagggtgatcgcgcttgcgtcaaaatgatcgcgtgccgcatacagcacctctgattcttttgaacttgacatgacattgatcgcacagcgatagcgcgtatcaggctcgcctagcacctcgacttgaaaatgcggagaatcatcatctgtttcccttttcatatctaacacagtgccttttaatacaccatagtgctgaacagccatatgaatcctcctttttcttccgggatatgaattgatattcgagacagggggccgtttttccttttgtgagaaagaaaaaaggacagcccgctgatcaggctgtcctcttcatctctattaagcttttgcagccgaaccttgcattgctttttcagcaggcacgtagtcatagcctaagtctttggctaccgcttcatacgtgacatgtccgttagccgtatttaagcccgctttaagcgcagggctgtctgcaatggcttgtgccgcgcctttattggcgatttgaagcgcgtaaggaacggttacattcgttaatgcgagcgtagacgtacgcggtacggcgcccggcatattggcgacagcgtagtgaacgacgccgtgtttttcgtaagtcggattatcgtgggttgtaatatgatcaacggtttccacaatgccgccctgatcgatggcaacatcaacaatgacggaacccggtttcatttgtttaaccatttcttccgtaacgagagtcggcgctttggctcccgggatgagcacggcgcagatcagaagatccgcttccgcgacggaatctgcaatatttacagggtttgacatcaatgttttaatctgatgcccgaaaatatcatcaagctgacgcaggcggtctgcgttcaaatcgatcattgtcacatcggcaccgagtccgacagccattttcgcggcatttgttccgacgccgccccctccgatgatcgtgacttttccgcgggatacacccggtacgccggctaataaaattccttttccgccctttggtttttcaagaaactgtgccccgatctgcgcggccattctgccggccacttcggacatcggcgtaagcagcggaagggaacgtccgtccgttaccgtttcgtacgcgatagctgtcacacctttttctgtaagcgctttagctaattccggctctgcggctaaatgaaggtaagtgaacaagaccagaccttgacggaaatacgcatactcttcagccagcggttcttttaccttcatgaccatttccgcatcccatacttgctttctgtcctccagaatttccgcccctgctgatacataatcttcatttgtaaagccgcttccgagtcccgctccggattccacaagaacccgatggccgtttccgataagctgtgaaacgcctccaggtgttaatgccactcgattttcattgtttttgatttcttttggaaccccgataatcatgtctgtttcccccaatgtttgtgtgatgcttcaagtgtagcgcgatttttgcgaaaattctttgtttgaaacagaaaataaaaaaacacggatttgtgaaatttcacgaacccatgctgcgaagtttgatatccaggtaaatcgtaaacttctcattcacattttttaagtcgatttctgcgatctggctgattcttttcagcctgtaattcaatgtattgacatggatgttaagcgctttagcggcggtgttgacattgctgtcggcatcaataaaatgttcgagcgtttttaccatatcggcttggtgctccctgtcatactgctcaagctttgacagggaatagttcatatagccgctgtgcttgcgtttttcatccaacacatcaaggtactgataaatgccgagttcagaaaagctgaaaaggtgtttggtttctctcacaaaccgctctttcgcttttaatacggaaagcgcttcctgataggatcggtaaacgtaagaaatcgattcgtaaataccgccgatcgcaatcgacgcatcctcaattttatatcgttccttcaactgtttttgaatatgaagagcgaagtgctttaaatctttaaaaggctgatcggttttcggcgcggctaataagattaattcatttgaatcaacagtcgccagcatgacatgaatctgctgtgtcgtttcctgcaaatattgcagctgctgttccgtcttttcagtcagctcatcatgtaaacggatgatcatgacgctgaacacggacggcagcgccattccgagcttatgaaacccttcggccatctcggcttcctgataaatatggccggtcagcattttccaaaaaaactcctggccccgctcttcgattttcgttttgcggatctgcaggtgcaaaagcttgttccgcaccgctttggctgccagctgaagtgtcttcagatcttcgtcattgagcttttttttgatctcaagcgcccaaataaatccgagaacctgactgtttttccagatggaaatcgccacgcggttgcttaggcccacctcgtcaatttctttcactttgatcggctggtccgtttttaaaagggccggaatggttccgtctttccacagtttgttgatgactttttccggcaccctccgcccgataatcgtcgacgtccgggcaggatctgtacaatcgctgtgcgtgctgtatgcaagcagtttatgattaacgtcttctattgtaatggggcattgaagaacttcactgatatggtcggcaacatcttcaagcctgtcgaaactgtacttaaatggatcttttggattggtcatctgtatccctactttttcatagcttcatatcttgatcttaccatcttgcttttcagactgaaaggcatctttgcagggaaatagactaggacaataagatcattcagtgaaaacgaaaataataagaaaatcatactattttatttacaaaatgtgtaattatgacgaaaaatccaatatatcataagactcattttgtaaaattaaaacagatttgtttgactgtgccgattggttgtttttataataatgacgttcaaaaaataagtgaattagcccatatttaggctgatgacacaggagggtataaggaatatgtctggattaattcgtgtcacacccgaagagctaagagcgatggctaagcaatatggcgttgaaagtcaggaagtcatgaatcaggttgaccgcctgaaccgcatgatttctgatttgaaaggcatgtgggaaggtgcttcaagtgaagcattcgcggatcaatatgagcagctgaaaccttcatttattaaaatgtctgaattgcttcaagatgtgaatcatcagctcgatcaaacggcaaatacgcttgagtctaccgaccaagatatcgctaaccaaattcgcggataataagatgaatgaagaaacggagcgcctgattcaatcaagaagacggcgctctttctatgtaagggtgatatgaatatgtatatcgatattacaatagatttaacacattataacggcagcgtcttcgatctcagattgtcagattaccattctgtgaaaaaagtcattgatattgcccggcaggctcagcatgtatccgttccgccgcgtgaaggctattggatcagagtggtcaataaagaaacggttttttccggagaacaaaagctatctgactgcggcattacgaacggagaccgccttgaaattttatgaaaggacatggtggaatgacaggtcataacagatcttatttagaaacagaattagacgccgtccgggaagaaaccgaatcaggcttcacgttcaccttccagcgggaaaaaatcaagcttcttgacgggctggaagcgaatgtgattaaagatgccgatcctttttttcaaaaagaggtctcagtttcagaagacgaagtaaccatcacaatcaaacctccttcttcttatcaggctttccgctatataaaaggaaaagataaaaaaagcaggtggcaatttgcctaccgtctcgtccaagccgtgaaacagcataagctgaaacgtctcaatctgattgccgcccctgaaaatatcgtgtttgataaagcgctgacgccttactttcttcattacggcgtaaaggagagccttccgccttatgaggaagatagagaaagggtgttaaaagagctcaaagcctgtgcggcgcttgcagctgacggggcgtacaccttcgatgaatatttgaagtacaaggagacgcttcatttctctcctgaggtgaaaagcgtgttagaggcggagacgattgaagaactggaagaagccattcaaaccgcaatcgattccctcgaagaaagggacaagacatacataaaactgccgaaaaagaaatggaaaatccaaagatacgccggtctggcgcttgccgtcctccttgtgccggcacttctttactccttatacgttctgtttttcgtccagccgaagcaagaggcaattacggaaagcaaccgctattttttaaatcagcagtacagcaaagtcattgacacactcgctaaatacgatgcggaaagcctcccggaatctgtgcagtacgagcttgcttcctcttatgtggcagttgaaaatctgagggaagaacagcggaaaaacatcgggaatctggtcacgctgcaatcagacccgaagcacttcctttattggattgatatcggcagaggggaaaatgaagaagccatcaaaatcggccgcaatcttgagtacaacccgtacatctggctcggacttacaaaatataaacagcaattattagcggatgacagtatgaaagacgacgaaaagcagaaagaactggacgccgtggaaagcgagcttgcgaaggcgaaaaaagaggcggaggaacagcataaagaagcggaggaaaacagtgacaccgccgaagcttccgccggacaagatgaaagcaaacaagacaaagcgaaagataacaaagagaacgacaagaaagatgagaaaaaagatgaaaaaaaataacagcacacatcaaatggccgcatgtaacgatcaggctgtcgtcaggaggttcgccatatgagtctgttatgggtcttttaccgagagcacgtacaaaaggttcagctgtctgaactcccgccctctcagccgattacgatcggtccggatatgaaagatacaatcacggtcggcacacttccgttacggcaaaacgccgcaaccctttatcggaaagaaacagatcgttatgatgttttcctgggaaataactgtgccggcgaattgacaataggaaatgaaatgccctgccggattgaagaagagacgatgcggcttctgctcacccctgaccaggaagaatcctccgtgtactttatcggcgggaaggatgagatcgttttctcatcagaaacagaggaagcggatatatacaaagagccgtcctccgctcaaacaggggctttttatctgcgtaagtcgggaggatgctggtctgtcgtccctgatggtcaggaagtttatgtgaacggaaagcttgcagaagctcccgaaaggctccggacgggagatgagctgctgtggaattttctgcgtgtgaggctgacggaggacgaccttttagaaatcgttcatcacgaaaagcttcaagccggtttaaccaaaacggtaaaaccaagcaccgaaatgaaaaagaaatacccgcaatatcgaagaacgccgcgcatggtctacgatcttcccgaagaccgcgtttcattcagctttccctcgcaggaaagcgaacagaataaccgggggctgtggctcgtcattctgcctcctgtggtcatgctgattgtaatgggggttgtcgctattatacagccgaggggcatattcatccttgtctctttggcgatgtttatgatgactctcattacgtccaccgtgcagtatttccgtgaaaaaaaccagcggaaaaaacgggaggaaaaacgggagcgtgtgtacaagcagtatttagaaagcaaacggaaagagcttcagacgctgtcggaaaaacagctgcacgtgctgacgcatcattttcccccgtttgaaaaaatgaaatatttaacttctgaaatcagcggccgcatttgggagaaatcgctggaaagcagggattttctgatgcttcggctcggaacgggcacggtcccgtcaagctacgagatttcaatgagcggcggagacctggcgaaccgtgatgtggatgacttgatggagcagtcgcagcacatgcagcgtgtgtataaagacatccgccatgcgcccgtgaccgttgatttacaagaagggccgatggggcttgtcgggaaacctcagatcgtcaaaaatgaaattcaccagctgatcggccagctcgcgttcttcaacagctaccatgacctgcgatttgtctttatctttcatgaggacgaatataaggaatgggaatggatgaagtggctgccgcaatttcagctgcctcatatgtatgcgaaaggatttatttacaatgaacagacccgcgatcaattgttatcgtccatttacgagctgctgcgggagcgggatttggaagaggataaagaaaaaaagatctttcagccgcattttgtctttgtcatcacaaatcagcagctgatcgcagagcacgtcattttagaatacatcgaaggccggcatgagcatctcggcatctcggccatcattgccgcggaaacaaaggaaagcctggcagaaaacattcacaccctcgtccgctacattaatgaagatgagggagacattctcattcaacagaaaaaagcggtgcagatcccgtttaagctggacaggcatgaacggacaaacaacgagcggttttcccggacgcttcggacattgcaccatcaggtcggaatgacgaattccattcctgaaacggtctcatttctcgagctgtttcatgcgaaggaagtaaaagaaatcggcatcaggcagaagtgggagacaagtgagtctgcaaaatcgctggctgttccgatcggctataaaggaaaagacgacatcgtctatttaaacctgcatgaaaaagcgcacgggccgcacggattgctggcgggaacgaccggctccgggaaaagtgaatttctgcaaacatatatcctgtcattggccgttcactttcacccgcatgaagcggcgtttttgctgattgactataagggcggaggaatggcgcagccgttccgcaaaatgccgcaccttctcgggaccatcacgaatattgaaggaagcagaaacttcagtatcagggcgcttgcatccattaagagcgagctgaaaaaacggcagcggctgtttgatcaatatcgcgtcaatcacatcaatgactatacaaaactgtataaacagggagaaacggatattccgatgccgcacctgtttttgatttcagatgaattcgccgagctgaaaagcgaagagcctgactttatcagggagcttgtcagcgcggcccgcatcggacggagccttggtgtgcatttaattctcgccacgcaaaagccgggcggcatcattgacgaccaaatatggagcaactcacgctttaaggtcgcgctgaaagtgcaggatgcaagtgacagtaaagaaatcctgaaaaacagtgatgcggcgaatattacggtcaccggacgcggctacttgcaagtcggaaataacgaagtgtatgagcagtttcagtctgcctggagcggcgccccttacatggaagatgtatacggcaccgaggatgacattgccatcgttaccgataccggcttaattccgctgtctgaggtggatgcggatgatgcggcgaaaaaagacgccccggcagaaatagaagccgtagtcgaagaaatcgagcggattcaaaatgaaatgggcattgaaaagctgccgagcccgtggcttccgccgcttgccgaacgtatcccgcgcacgctttaccccgcgcaggaaaaagaccgcttcttcatcgcctgcgttgatgagcctgatcagcaaagacaggcgcctctcgcttacacaatgatggatgacggcaacatcggcattttcggctcatccggctacggcaagtcagtggctgccatcaccttcctgatgaatttcgcggaaggatacacgccggaagagcttcatatgtacatctttgacttcggaaacggcacgcttctgccattggcaaagcttccgcacaccgcagactatttcttaatggatcaaatgagaaagatcgaaaaattcatgatccgcatcaaggaagaaatcgagcggcggaaacggctgttcagggaaaaagaagtcagccatatcaaaatgtacaattcgctcagtgaagaagagctgccgtttatatttatcacaattgacaatttcgacatcgtcaaagacgaaatgcatgaattagaaacggaatttatccagatttcacgcgacgggcaaagcttaggcatttacttcctgctgaccgcaacgagggtaaacgccgtccgccagtcgctgttaaacaacataaaaacgaaagtcgtccattatttaatggatcagtcagaaggatactccatttacgggcgtccgccgttcagtctcgaaccgatcccgggccgcgtcatgatccaaaaagaagaactgtatttcgcgcaaatgtttcttccggctgaagcggaaaatgacctcgagatgttccaggcgctgaaagctgatgtcaaagctttagctgagcgccacgccggaacagccggaccagacccgattccgatgcttccggatatgctgacggccggcgaattttcactccgtctcggcccggaacaagacccgttccgcattcctgtcgggcttcatgaggaaaaggtcagccctgtgtactttgatctgggtaaaaataagcattgtcttattttgggccagacacagcgtggaaaaacaaatatcctgaaagtgatgctgaatcacctgctgcgtgaaggtgcggaacgggtcgggctgtttgactcgattgaccgcggactgtcgcagtatgcgcaggaaacaaaggtcagctatctggacacaaaagaagacgtccggcagtggatcgaaacggcagaagccattttcacggagcgcgaagctcagtatacgcaggccgtcaaaaatggcgatgtgcacaaactcagtttctctccggtcgtgttaatggccgacggcattacaagattccagcagacgatcgacaccgccttacaggacaagctggcgatgtttatgaaatcttacgcgcatgtgggcttcagttttatcccggcgggcaatcacagcgaattctcaaaaggctatgattccttaacgacggaaatgaaacagatccgccacgcgatgctgcttgtgaaaaaatccgaacaaaatgtcattccgctgccttaccaaaggcaggaaccggacattcagccgggcttcggctatttggttgaaaacgggaaggagcaaaaaatccaaatacctttatgttcagcggaaagggaggccgtcagatgaccgaacaacgaaaaagcctgatcaaattaatagccgcggtcgtcatcattctgctgctgccggtgctgtttttccggtttatcggcgatgacccgggaaaacaaaaaatcaacgccacccgccaaatcgcagtcgtgaatgaagatatgggcttacaaacagatgaaaatgaggaagaggaatccgtccatttcggcaaagaagtagcggccgctctcggcggccgtccggattattcatggacggttgtcaacaggagcgcggcagaaaacggtctggcggctaagaaatatgacgccgtcgtttacattccatccgatttttcaaaagacatcttaagctatgacaaggagcgtccgcaaaaagccacgctgacattcaatattcaaagcaacctgaacgccgtcaacaaagaaaaagtgcagcgtgagcttgaagacgcccaaaaatcaatgaataaaaaaatgtcggcattatattggaatttcgtctcacaaaaagtgaacaatgtccgaggcgattttgacaagatcgtcaataaagaatcagagtttcaaaatgtcatgtacaacttttacaagccgagctccaatgacttggcaggtgaaatcaaacggcaaaaagacctgattgacgaactgaaaaaatcaatgaatgaagcgcagggcgcggcaaaagaaaaactgacttcggcagatgaagccaaaaccacgctcaaagactttgccgacacggtcgagcgctacaaacaatatcaagaaaatcagaaaaaactgctgatggccgcgcaggaacaaaatcaaaagcaaatcacaaccggactgaacgccattaaagcacagcaggccgccaaccagttcagcacgatgatgagcgggctctcttcaggcataaaccgggcgcagacacagcttgaccagacgggatcggctctttttgccgcccaacaggtgagagaagcgcaggttcctgatcaggaacgcgggatggcgaatattcaatccaatttactggacaattatttgactcaatataaagcgcaagcaagatttgaaacattgaacagcattcaaacccttatgaaaagggatcggccggcattaaccgttccggaaaaggacccgggtgatgacggctcggatgaaccgaaagaagaagaaaaaccggaagaagaaaaacccggcgatctgaaaattgaccttgacgatcagcgtgacgaattaaaacgcatctccgctgaaatcaatcacatttctgacggattaaaagaaccggaaaaagaaaaaccggaaccggaagaaccgggccaaggcgatgacggtgaaaactccggcgataccgatccgaataacggaacggctcccggagaagacggaaaaacggaagacggcacaaaagaagagcagcctgcctccgataacacaggcgatcaggagccaaaaaccgtccagacctcgacagccgctgaaaacgtcactccgcctgctgatgagccggcggacgatccaaacgattctgaaagggacggcggcacggacatatctgaggcaaaagaaaggctgaaccaagccgcagaacgcattcagcaaattgaaaaagagctggaagagaaacagcagactcataataaagaactgaaaaaacgtctcgatgctcttgatgaagaaatccaaggccttaaaaatcagattgccaaagttgaaaaacgggcagataaattaaaggaaaatttggaagaattggaagaaacgagaaaacaagacttcgataccgtttacagaatgattgtaagaacagaacagaacattctgaactacccgtcattggatagcggccgcaaatctgctcttgaacagatgtttgccgctgacatcaatacaaaaaagatatccgatttaatgagttactataatgatttatccctgtatgaggcgacactctatcactctcttgacgcgggctcgctgcctgatgtgaaaaaccgggtgctgaaagcccagcaaggtgaagtccaaaccgttcttgccatcaaaccggaagaaacggcaagctgggaaaatctgaaaaacaacaaaatgcagactgatgaagacatcagcaatttcattaaaggcatgaccgaattctcggataactacagctcgtatatcagagatgagcaagccggggtgctcgatgagcttgccagcatttcagacagcgcggcgaaagcatccgatcagctggctgaaggcgctgtgcaggaagcggccgcgttcagcggagacggattaaccggaacgatggcgctcggcgctcaggataccgtcggccgtgaagtcctgcaaatgtctgacacgatgggccatctgtcagaacgccagtccggcatcatcagctataccgacaatatgcagcaaagcgtaaatgacgtccagcaaaaagcggacaccctgaacagcaactggggcaaaaacgtcgattccacgaaattgatcagaaatgacgtgtacggcattttagggaacgcgctcgttgacggacaggaaaacggatatgtttatgattatctcgccaatccgcttaaaatcagcggagaggtgccggaagaccgggttcagaatgttccgccggtcgtcattttggtgatcgtcctgatcagcagtcttctgatcggctatttcagctcgtattatcagcaggcgccgcttcttgtcaaaggcgcgctctttgggattttaaacattatggtcggattgatgatcagtctgttcggtctgaatatctattcgcttccggatgatcagacgattaaatggtcagtctttacgattctcctgcttgcggcgagttcagcttttatccgggcagcctttgtcttcagctcaattaccggatggatcgcatcatcagcgctcattctcttttatgtggcgcctttgatcgacctgattatgccgaacttcacctttgacagtccggtttcgaaagtctatatcgatattcaatacggaacgggccatctgtttgcgttgggggtaacggttcttgcgatcattacgctgattgcggcggcgcttccgctcgtcattcggctgtttgcggaaaaaacggaggaaagtgatcagtcttatgaggcgtaacacgttcatggaaaaaggattgctgctgtttgctctctcctttttccttttccttccccaagccgcagccgcgaatgaggaaaatactgatgtcaagccgaatgaatatgaaaagaaagacattgaaattcgtacggactacctgcacgacgatgcctactccgaggaaaaaacggcgcttccgaaagaacagaaggatatcacgtttgatcagccggccgaaaacccggatgacaaactgatatcaaatttgtttacatcgtcagacacggagccgaatacgatcaaagcgcaatcgaaacaactgggtatcacatttgccgagccggcggtgcggcatacctcggcagatatggaaacggaagagaaaaagacttcttatctgcttcccgctatttatgccgtcttgatcctcctcgggattgcggcaatgatctatctgatcccgaaagtcacggcgcaggaaaaggcaaagcggtaaaacggatcgcttgtgtttgcgggaagacagcccgtaaaataagaaaaaaaggaggagtttcatgcagttttttcttataacaggcgcgtcaaaaggcttgggccgggcgcttacggaacaggcgcttcaagaaggagccgaagtcgccgcgctttcaagaacgataagcggggaaaagcgcgaggggctgacagaatacagtgttgatttaaccgatctcgcagataccgggcggcagatgaaggcgattcttgatcaagcagaggagaaggggtactccgccgtcacactgatcaacaatgccggaatggtggaaccgatcaagcgggcgaaagaggcttccgccgaagaattgaaccgccattacacccttaacctgacggcgcccgttttgctcagccaaatgttcacaaagcgcttcgaagcgttcagcggcagcaaaacaattgtcaacatcacatcgggcgcggcgaaaaatccttataaaggctggagcgcgtattgcagctcaaaagcggggcttgatatgtttacgagaacattcgggtttgaacaggaagatgaagagctgccggtccgcatgatatcattctcgccgggagtgatggatacagacatgcagtcggtcatccgttcttcgtcaaaagaagatttccatgacatcgaacggttccgcaatctgaaagaaacgaaaaacctcagaagtcctgaatacatcgccggcgtcattcactcactgatcgcgggcgagccggaaaacggacggatatacgatatcaaagaatttttgtagagcagctttcacgctgctctttttttgtttgtacaatcacttaggggtccggcggcatatgatgaatgaaacaacatataaggggtataagaaatgtatcagatgaattgagtttcttctcgatttatgttaggattctaaaaatatatgaaggaggggtttccatgagaaatgtaacgttaatggatgtcttcacccatccaatcgcacaaaagtatttacagcgttccggtgtcgcccatgcgatcgcctgcgcgtttcatgcataccgtcttgccgtaaaagcaggtgtcagcccggatctggcggcgaaagcggcattactgcatgacgtcggccattatgaatggtacacagacggcaaatgggattatgaaaagtacagaagaaatgatatccatgccattaaaggcgcggaacgggcgcataagctgctcatccggctcggtgaagaaccgaaagcggcgaaggacattgcgctggcgattctgcttcacaccgattcctatctgcctgaaggcgaactggacaagaatacgctccagcaaatcgtgaaacaagcggatgaactcgatgaagaacccggcggacatcaccattaccgccaaatggatcacacggccgcgctcaaacaaatccaaaagcttgatcagttaattgaccgagcccaatatcccataagaagctcagtctaggccactcatgcggccttttccgcttacataactccgcatgctcactaacaccttttccgctccgatagacgtactgtgtcaaagcctttgtccgctgcatatgctgaaggaaaacatagtaaaggggatcagcgaaaatggcccatcaaggaagcccgcaaatcgtctcgttagtggatccttacgtttatcagaccatccataagcttatcggctcaaggtttatcattcaaaccgtcagacgcattgtcagaggacggctgattgatgccactccggatcacatcgccattgaagagacgcatgaccgtgtattttatatcagaaaccgccatgtggtttccgtcatgcctgattataccgaacgcgtgtaacagcccgaaaaggcgcaaaccggaggcggcactatagaaccccggtgcgtcttcttttttgagatacatagatgcacggcggctttttttggtacaatcacagtacaagttcacacgacaataggaggaaaccgcttgttgaaatcaaaggtccatttttggacgctgcaaattttgctcgttttgctcattatttacgtatcaacgaaagtctcgtttatatttcagccgtttttcggttttatcaccactctgttttttccgattttgatctcgggcattttgtttttcatttttaatccgatcgtgcgcctgcttgagaaaaaaatcccccggacattggcgatcctgctcatttatctcgttttcatcggtctgattgcctttatgttcactgccatcgggccgattgtggcttcccaggtcacggggctgattaacaatttccctgattacattcatcagattcaagtcttgacggcgcaattatcccattccaaatggtttacgtggatgatgacgcaggattatgtgtcgatagaaaaaatccagcagtctctgacgggatttttacaaagccttccgcaaaatattacggcaagcctgtcggccgtgttcggcgtcgttacgaatatcacgcttgtcgtgatcaccgttccgttcattttgttttatatgctgaaggacggccggcggtttccgctcttggcggtcaaaattctgccttcttcctaccgggcggaaggtcggaaaatatttaacgacttatatgtcacattggccgcctatttccaaggccagctgctgatttgtctctttgtcggaacggcatgttttatcggatattggatcatcggcctgccgtatgcgttaattctcgggatggtgatcgccgtcaccaatatcattccgtacctggggccgtttctcggggcggcgcccgcggtgattattgcgtttatggattcgccggctaaggcgctgtttgccgttattgttgtcgttgtcgtccagcagcttgacgggaacctgctttctccgcttgtgattggaaaacggctgaatacccacccgctcaccattattcttctgcttatcggagcgggcagtttcggcggcattctcgcaatgatcctggccgtgccggtttacgcggttttaaaagctttcgtcttaaatatcgtccggcttatcaaacttcgtcagcggtcaaagctcgaagacagccgcaagccgaaataaaaacgggcacaactcccggtgcagcgcataaaatgctgtaaagaaaagcggaggtgtgggtatgcctgcaattgtgggaccgatttatattatgagtttagccggagacgctgcagcgagcttcggtgacgtgtttgccatttctcccaaagccgttgaccactcaggcgcgggggcaggggcgtttcattccggagattttgtcaaaattactaataaattcagcaaaacgcgctttgaagacattgatgtgtttgacgaacctgattggtttaacgcgtgacagcctccttttaggaggctgtcgcttttttgtagtataatagaatcagtctttataaaaggggaatgttttatgaaaatcagaaaagcgaatattaccgtgcagtccggaatgatcggtgatgtatatctgcatgaaaataaaaaagaacagcatacccttgtagccgttccggaacttgagtggagcacgatcatttcctatgaggaagagaaaaaggcgctggcgcagcggcttttacaatcattcagcaagctgattgaagaagaacccgccggagagctcgccggcaagatctcccattgggtggctgaaatgtaacgaaaacggtttaccgcgtcccgtccggggcgataattgtaaaacaagctgggagggacaggccgatgagcgacaaaacggttgacctttatttacagcaggggatgtacggccctttgcagacgaaaccggatgaacgccatttatttttaggctcgctgcgtgaaagagtcatcattgccctgacgaagggacaggtgctgcaaaagcagccgtatgaagaagtgaaacaggcgctgaaaagccgaaaagacgcggtgctctatataaacggaaggctcccgtatcatgcttattcaccatatatgaagcttgccgcacttgccggtgtccgaagctccgtcatctcggaccttcaattcgaaacgccgctcggcctggtttttgccgccgattatgccgtgaaccttgacggcatttacgtgcaggatgacatttttcagcgctcactcctgaaatcttaaaagggcaaaacactgtttgtcattttacaatgccaattcacttacaagtggagataggatataatggttttcatatgaatggcggggaggccggctatgaaaaaagcatttatatgcattgattatacgaatgattttgcagctgagaacggggcattaacctgcggagaacccgcgagacagattgaagatacgattgtcagtttgacgcaagcatttatagaaaacggtgattacgttgtctttgcggtagattcgcatgatgcagacgatgactttcatcccgagacacgcctgtttcctccgcataatatcaacggcacggagggcaaagagctgtacggaaggctatcgcctctttatgagaaacataaacacgcaaaaaacgtaaattatatggaaaaaacgagatattctgcttttgcgggaacggatttagagctgaaactgcgggaacggcagatcactgagctgcatcttgcgggcctgtgcaccgacatctgcgttcttcacacggcggttgacgcctacaacaagggctttcagatcgtcattcatcaaaacgctgtggccagctttaatccggaagggcatgaatgggccctgtcccattttaagaacagcatcggagcgcaagtggcagagtaaggaaggggaaaacaattttggtggagcatggttttaaagacgacagtttgtctttacatacagacctttatcaaattaatatggccgaaacgtactggagagacggcattcatgagaaaaaagcgatttttgagctttttttcagaaagcttccctttgaaaacggctatgcggtatttgcgggcttagaaaaagcaatcgaatacttggagaacttcaaatttaccgacagcgatctgaattatttaaaaacggaattgcactatgctgatgatttcattgattatttacgggatctttcttttaccggatctctttacagcatgaaagaaggcgagctcgtttttaacaatgaaccgattatgcgggtcgaagcacccctgattgaagcgcagctgattgagacggctctgcttaacattgtgaattaccaaacattaatcgccacgaaagcggcccgcattaaaggcgttgtcggtgatgaagacgccctcgaattcggaacgcggcgcgcccatgaaatggatgcggccatgtggggagcgagagcggctttgatcggcggcttcagcgcgacgagtaatgtaagagccggaaagcgttttaatataccggtatccggcacgcacgctcatgcgctcgtacaagcgtaccgcgatgaatatacggcatttaagaaatatgcggagacccacaaagactgcgtatttctcgtagatacgtacgatacgatccgttcaggcatgccgaatgcgattaaagtcgcaaaggaattcggcgaccggatcaacttcatcggcatccgcctggacagcggggacttggcgtacctgtcaaaaaaagcgcgtgaaatgcttgatgaagcgggtttcacagacgcaaaggtcattgcttcaagcgatcttgatgagcacacgatattaaacctgaaatcccaaggagcgaaaatcgatacgtggggcatcggcacgaagctgattaccgcatacgatcagccggctctcggcgcggtttataagcttgtcgccattgaagaggacggcaaactgaccgacaccattaaaatttcgtcaaaccctgaaaaagtgacaacgccgggaagaaagagagtataccggattatcaacaagctgaatcaccactcggaaggtgattatatcgcgctttatgacgagcgggtaaatgatcagaaacgcttaaaaatgttccatcccgtccacacgttcgtcagcaaattcgtcactgacttctatgcgaaagacttgcatgagccgatctttgaaaacggcgttttatgctatgataatcccgaaattaccgacatccagcaatacgtgcaggataacctcaaacttctgtgggaggaatacaaacggatcagcaagccggaagaatatccggtcgatttaagcgaagactgctggagcaacaagatgcagcggattcatgaaatcaaaagcaagctgaaacgggaacttgaatagaaaacaaagcggcctttcctatctctggaaaggcttttttgttgtgataatatttttcacatttagacaaatttcgtcaagttatttgatatacttatgttcgaaggccgcatctaagggggtaaatgaatgaaggtgtttgttgcgagacagcctatcttcaacagaaacgaacaggttgttgcttatgaacttctttaccgggagagcgaagagaaccgttattcggccgcggatggagataaagctacgacggatctcattattaacagctttatcaacatcggaatcgaaaagctgactgaggggaaacgctgctttgtgaattttacagaaagcctgatgttttcagatctccctacctcctttgatcctgaccagcttattatcgaaattcttgaggacataccgatcactccggcgctcatctcaagatgcagacagctgaagaaattaggatatacattagcacttgatgatttttacgccatcaatccggaaaatgaagagttagtggaacagctgatgaaatatattgatattttaaaaatcgactttttgcaatcctcgcgtctggagcgcaaaaaaatcattcagacgtacagctgtaaaagtctgatttatttagcggagaaagtggagacgagaaaagattataaacaggcggccatagacggctttcacctgtttcaaggatattttttcagtgaaccgcgtgtcatcagcggaaatgatctgacgtttcattttcattcttactaccagcttttaagcgaattaaacaatgaccagcctaatatacagcgcgtgacggaatacatagagcgtgacgtcagcttatcgtatcagattctgcgttttttaaacggatcgcaaacaagactgaaaaaaaagatagacagcatccagcaggccatcatgatgctcgggctgaatgagattaagcgcttgatttacattctttcattcagagatttaacggcgaaaagccactcaagccaaaaagaaatcattaagatttccttaatcagggccaaactgtgcgaactgctggcgaaaagaaccggaaggccccagccctcttcttacatgctgatcggcatgttttcgctcatcgatacgcttctccacagggaactggaggatatcatcaaagaactgcctttaatcgatgaagtcggacaggcgctgctcggttatgaaaacgattattataagatgctcgcgctcgtcaaagccattgaatgcaacaactgggactgtgacgagtggggaaaagaactgaacaaagaagaagcgtatgaatgttacttacaggcgatcgaatggtgccggcagctgatcgattgagccgctttaagccgaccatctgagggcgatgataaaccggctttgctctctgatcagactgacacggatgccgtcgggattatacgtcacgtcaaagtcatttttgatgccggtctgcttaatgagccgcttgaccgctgcggtgtcagatgattgcgctgcggtgaggatgctgcgcgcaagctcttttgacgccgacagccgcgcaaggagcaggcgcgcatcctccagcatgcccgcagcttcttttgcggacgctgtcaaaatatctgcgtgaaccggggcactgggcgctggatgccggtatggcgcggcgaaaacagggcagcatggatacacataatgcatacggcggcctccttcctgagaaaacattcgttatacatgagtataggcggcgtgataatgagttatgacatgcaaaaagaccacaatgcgggggttgcggtcttttcggtgtttgtcggtggttatgcgacgctgtttgcccattctgttttgaaattgtgacggcagggactatagtccctgccggtttgtcggaaaaccgttgaaaaaacagcagaaccgccagattggtctgctttatcctaaacgtctgcctttgcggtagttatatagtcctgttcgctaaatgccctgttcgggactatggaattaccttggtttgcggtgtcacgcagatacttttacacatacttttcggtgaaaaatcccgcaaaaacgtttacactattagtaacagatcaaatacctaggactcgttcaccatacacaattcattgatctttcaaaaaaaggagtgtggaaacggtggaaaacaaattagaagaagtaaagcaattattattccgacttgaaaatgatatcagagaaacaaccgactcattacgaaacattaacaaaagcattgatcagctcgataaattctcatatgcaatgaaaatttcttaaaaagacttggaaacaagtcttttttttgtgcattttttatccatttcatggataaagtattatacgattgttaaaaaacgaaaaacctgctgtctttcatcacctgcatttagtaaaatagaatgggagggtgaagacaattattgagcaaatgtgtttagatgccgaaacgattaaagagaagatgaaggaaattgtggaggagaaaataaataatccacatttaaaagacacccttcagacttttataaatgaaaaaaatcattttgcttttggtgttcttgcatttaagcattatgtggctttcgatggtgagcattattcggatattacgttattagcttcaggaattgaattgttaattttagcttttgatatttttgacgatatagaggatgaagataacttggataaggaatggatgaagatagatcaatctatctctttaaatgcagccacttctctttattcaataagtcttcaagtgatttgtgagcttaaaacgaactccgattttccccggcttgctatgaaatatgctttaaatgcaatgcaaggtcagcataatgacctcgaaaatttccccgaaactgaagacgaatgtcttcaaatgattaaacaaaaatcaggctcgcttactgcaatgtcagctgtattaggaacaatgcttgcaaatggggagtttaacgaagaaattgagaattattcctataaaattggaattgttaaacagattgaaaatgattattatggtctttttaataaaaatcgtagtgatatcagaaagggaagaaaaacattaattctgttgtatctaaagcgaagatttaatgctgcttcagaaaaaatcttggatttaatgaatgcagaagcaagttaccattcattcctcattgataataaaaaaagccttgaagacctactatttgatgcaggagttagccagtatgtttcaatgttaattaaaatgtacgaggaagaaattacgacaagtataaaagatttaaatataatgttagaactttaatggaggaaattacagtgaagcaagatatcgtacattatcttatggaaaatccacttgtacttacaaagttagcgtgtggggaagctagtttaataggagttccggataaactgttacctgccattgttgagatttttgaaagggacttaagtcaatcaaaaaaatgcaggggaattttttgggaacaatgattgagagagtgagatctattgaaaaaattcattagaaatttttcgattgtattgttattcgtcagtctcttttacgtcgctcatattatatattttactcaaaacggaattttggtaggaacctatgtggttgaaaacaataaccatgaattgcaggttgtaaaactctccaagtctacgtatggtaaatatatgggcttaaaagagggagacaggataattgaaataagcggaaaaacaccgacagaagagaatataagaggtcaatatctagcgaaagctgaacatatgaaaataataaggggtaatagtaaaatagacttacataatactgagtttatttccttaaatagctcttatagtttttttatctatattatcccatgcatattatttgctttaagcatgttatgcattttttatatttataaagttaacagagtaaaagatacttattcagcctttattttgattatttttttattgtgtacatccattgcatatttaagcgcaggtggagtaactagaggatatgaaataaacagatatattaacctttttacatttttgaacgtacctgtattatactttcactttttgtatcaatactttaaagaattaaaattgaaattttcagctggttatgttgtgtctactctctatatattgccggttattaatataataatcgagatattccagaagcattttgccttccaacttgttacgaatattaatttagtaacattttttttggaaatgatggtcgtctatacatccattattttttatggactagtctaccgaaaaaaggatcacttttatttgctgaaagtattacttatatctaataccatagccttttttccgtttacagtattttatattatacctgaggtgttgttcggacagtatatttattctgctatagttacggcaccatttttaataattattccattagctttagtctatcaattcgtggtcaataaaatctacgatatagacttcttgttgggcagaattagatactatggtttcctttccattattccgactattggagttgtatggctgaatatattattcgacagcaaggggaataactttaacattattcaaatcactgtatatgtatttttgatttttttagcggtattttatattaaggagttattagactacaaatttcgcctgaaacgtttttcagaaaaatataattatcaagacagcatatttaaatatacacagcttcttaaaagcgtatcagctttaaaccaagtgtttatgaatcttaaaaagacgatattagatgtgttgcctgtcagtaaggcatatatctttgaaatcagttctgacggagatattctgtattttgataaacagaacagtgaaccgaactggcagccgtataaaaaagaatttgttaaagtctcatcagagattggcaagatttttgaagtaaatcaaggttttctgatgaagattggagaaagaggggcaaactcatacgttctgctttgtttgtcgagcattaatactccgagactgacaagagatgagatatcttggttaaagacattgtctttttatacaagtgtttcgatggaaaacatattgcagatcgaagaactcatgaaccatttacaagacctgaaacaacaaggctcaaacccggtctggctcaaaaagctgatgtttacgatcgaggaaaagcagcgttcggatttggcccgtgatctgcatgattcagtgctgcaggatttgatttctttgaagcgccagtgtgagctgtttctggccgattttaagaaagaggagccttgccagttagaggtgcaggacaagcttcatcagatgaatgagcagatgtcggatgtcattttgatgacccgggagacgtgccatgagcttcggcctcagctgctgtatgatttgggtctggtcaaggcggtatccaagcttgccgcgcagcagcaagagcgtgcgccgtttcatatccgtctgaatacgggccggtttacggcggcgctggatttggatacgcagctgaatttgtaccgcattattcaggaatttctttcgaacgccatgaagcattcacaggcgaatgaggtgctgattatgctgatcagcattcaaaataaagtgattctgcattatgaagacgacggtgtcggctgcaatcaggaagaaggcggcggacagtcgatgagcatgggtctttcgggtattaaggagcgcgtccgtgcgcttgacggacggatgaaaatcgacacaagtgaaggaaacggttttaaagcggatattgaaatggaattgtaaccattttatcaccaaatcgacttggcagaagccaagtctttttaataaaatggaaatgagtgagtaaaagggaggaaaccatgaaaaagatactagtgattgatgatcatccggctgtcatggagggcaccaagacgattctggaaacggacacgaatctttctgtcgattgcctcagtcctgatgccagtgaacaattcgttctccggcatgatttttcagcttacgatctcatattaatggatttaaatctgggtgatgacatcagcggcatcgagctttccaagaaaatcttaaaagagaatcctctctgtaaaatcattgtctacacaggctatgaggttgaagattattttgaagaatccatccgcgcgggcctgcatggcgccatcagcaaaaccgaatctaaagagaaaatcatgcaatacatatatcacgtgctcaacggacagattttagttgatttctcctatttcaaacagctgatgacccagcaaaaaacaaaaacgtcttcttcccctcaaagtgagcaggatcggttaaccccgagagagcgccatattctccaagaggtcgaaaaaggtttgaccaatcaggaaatcgcagatgcgcttcacttaagcaagcggtcgattgaatacagcctgacatccatttttaataagctgaatgtcggctcccgaactgaagcggtgctgatcgccaagtcagataacgtactataaatcttgaagggagaatgacctatgaatctgaacaatacattgctcggcgcactcggtattgaaatcactgaaaacacgccggagagatgcgtggcggtgatgccggtggataagaggacggtgcagcctttcggatatctgcatgggggcgcgtcagcagcgctggcggagactgctgcaagtgtcggggcccagcattttatcgaccggtcgaaacaggcgtgtgtcgggcttgagattaatgccaatcatttaaagtcagtgaaagagggcggaacggtcacggcgatagcggaacccgttcacacaggcagggcaaccattgtgtacgggattaacattttcgatgaacgagaaaggctgatctgtgtttcccgctgtacgctggctgttataacaaaataaacaaacagccggaaccctgaatcgtccggctgtttgtttttacaaatatgaatcttcttttcgtttgatcacaaagtttctgatccctttgtaatcatcctgaacgcttcttttatcaagcgccgctcccgaattgtacgcggccctgcatatgaggtgcgctccgaccggcgccgtcagcaggataaaaatgatgccgagcagtatttttacagaaatttctccggtcagcatccacaagtagcctaacaccccgagcaataccaaattaacgccgagtgtcgagccttttgaagaggcgtgggcgcgcgtatacacatcaggaagcctgagtgtgccgaaagacgcgaccaggcagatcagcgatcccatcagaatacaaacggcgacggcccatttaacgatttcgatcattttcgataatctctcctttctccaaaaacttagcaaaggcaatcgtgccgataaacgataaaatgccgagcagcagaatgatgtccaaaaaggccgatgtgtttaagagaatggatacaagcgcggtcatggcaatcagattaatgccgatcccatcaagcgcgacgacccggtccggtatcgtcggccctttcatgacgcgaatgacgtacagaagagtcgaaaccgccataatgccgagtgataattgcagaataaacgtaaacatcagcggctcacctcctgaatggctttttcaaaagagacgcggatgtcgtggatcgctttctccgcatcttcaatatccatggcgtgtatatagagaatcgaccggtcatcggagatatccatcacgagcgtacccggtgttaaagtgattaacagcgagagcaacgtgatctcccaatcctccgtcaattccgtcttaaacgcgaaaatgcccgggcggatgttcagtttcggcgctataacggttttcagcacgctgacattggccaaatataattcctttataaagatcagcaccagtctgatgactgaccatattttccaaatgtaaaacggccgcgagaagaagcgccggaaaaaaaacagcgccgccaagcctgcgataaatccggttataaaacccgccgtgctgaggctgtttgtgagaaacatccagcaaacagcgagaagaacgtttaataatagttgaaaagccatgccatctactccttcaaaacagcttcaatgtatttttccggattcagcagattctcagccgtctgattgacatacggtgaaacccattcggttccgagcccgaacagaagcgacaaaaggagaaaagcggctgccggataaagaagtccttttgcggaccgtccgcctgcgccggggatttctttttcttcgccccaaaaagccgtcgtaaaaaccttcagcaccgaatagagcacaagcaggcttgatacaagaatcaatacggaaaacaatgtttcccccttatcgaacccgccttccgcgatcttcagcttgcccacaaatccgctgaacggcgggatgccggccaaagatatggctgaaataaagaacatccatcctaaaacgggataacgggtgatcagtccgcccattttatgcaggctggcagtgcctgtcaatgcgataagcgtgccggcaagcataaacagcgctcctttaatcagcatatcgtgaatcaagtaataaaccgctccttgaatggaggccggcgtgttcatggcaatgccgaacaaaatcacgccgacggctgtaataatattgtagatgacgattttcatgacatccgaaaaggcgatagatccgattacgccgaatagcaccgtcagcatcgcaagccacatcatcaattggtgggtaaagcccgtatcgtgaataaagatcagggtgaatactcttaaaatggcatacaggccgactttcgtcaaaagagacccgaataaagccgaaattgcagccggcggggcgtaataagagcccggcatccagaaatacagcgggaatatcccgccctttaaaccgaaaacgacgagaagaaggatgccgatgacggttatcagcccggtctggcccgattcgcttatttttacgcttagatcagccatattcagcgtgcccgtcaccgcatataagtaaccgacaccgatgacaaaaaacgcggatgacacaatgttaaacacgatatacttcaatgattctcttaattgaattttcgttccgccaagcacgatcagcatgtaggacgcgataagcagaagctcaaaaaagacgtacatgttgaacaggtcacccgtcaaaaacgctccgcttacgccagccagaagaaactgcacccctgaataatagaaagcgcgctcccttttttctccgatggagcggaaggagtacagggtgacgagcagcccgattatggcggttgtcaaaacaagcagtgcggcaagctgatccgcggcgagcacaatgccgtacggcgctttccagccgccgagtgtcagcgtctgaatcccgtgtgtgaaaaccgtctgaacgagagcggcgctgatgacgatggagacacaggaagcggcagtgctgaatatccgcatcagcatcacgtgcctgttcataaaaatcagcagcactgcggcaagcagcggcaccagaataggcaatatcacaaagttattcatgttgatcatttcccctcattcgatccatatcgtccgttttcagttcctgataggcgcgaaacgccatcacaagcaggaaggacgtgacgccgaacgaaataacgatcgccgtcagtatgagtgcctgcggcagcggatcgacaaaggacgtgctttttccgcccagtatgggaggagcgccttttttcagtccgcccatggtcaggagcagcaaatggacgccgtggctcaaaagcgcggtgccgataatcacgcgcagcagacttttagaaagcagcaggtaggttgccgccataaacaaaataccggcaatgacagacattaagatttccactattcttcctctccaatcgtttgaataatggtcatcgtcacgccgacaacaacgagatacacacctaaatcaaacaaagtggccgtcgcaagctccgtattcccgagcaccgggagatgaaaatggccgaatgtatgggtgagaaagggcgctccgaataagaacgaacctgcacccgttgcaatcgcgataagcagacccgcgcccgccacataaataaaattgacgggcaaaatcgatttgacggtttttaaatcaaaggccaaaagcagcagcacgatggccgaagacgtaatcagtccgccgacaaatcctccgccgggggcgttatgccccgataaaaataaatagaaagagaaaagcagaatgataaaagatacaagcttcgttgccgtctgaaggatgatgtcgtttgtttttggctgtctcaacgcttttctccctcctctgttacttttgttctgatcatgccgtaaatcccgagtgcggcaatcgacagcaccgtaatttcaaacatcgtgtcaaatcccctgaaatcaacgaggatgacgttgacgatattgtttcctcccccgagcttatggctgtaagcggtgaaaaaggaggagatgctgtcttttgttttttcgctggaagacgcgattccgagcattgtcacgatgacgccgacaccgagagaaatgataaaattcgtcatccggaatgttcttgtcttctttttccgccgcattttcggcagatggtaaaaacaaagaagaaacaaggcgacggatatcgtctcaatgacgagctgcgtgagcgccagatcgggcgctctgaaaatcacgaaaaacagcgcgagtgtgtacccgacaacaccgagtgagataatggccgtcagccgtgatttggcgaacacagtcgcaatcgttgcgttcaccataacgagggacagcacgatttcatacaggccgatctcagccattcctttcgctgtcatggaaaagccgcctttcatgacgaacgccgctccgatgagaatgataaacgacgcaaagatatacagcagataatcccgcaaaaatccggtcatataagatgacgtcagctggtaagatcttttttccatactgcccgtcaccgcatcgtaaagcttgttcagcgtcagttttttcggaaacagaccgtacagacgctcccatttagacagcgttacgtaaccgatcgtgccgacaatgatgatgccgagggtcatcattacctcagccgtcaccccgtgccactgggaaatatggacatggaatgtatctccgccggttaacagagcgggataaatggagttcatcgccggttcaatcaggctgtaagacaaaacgttcggagcaaaaaacagactgacggcgcaagcggcaagaatcaccggcgaaatcagcatgccgagcggagcttcatgcggcgtcttttcaagctgatccgttttgcgcgcgccgctgaacgttctgaaaaacagcttcatgctgtagatgaaagtgaagacgctcccgatccatgcgagaacggggaacagcacgccccacgtatccaggctgaaaatatctgcatgagcaatccgcagcatacttgtaaagaacatttctttacttaaaaagccgttaaacggagggagaccggccatggaaaacgttccgatcagtgaaacggtgaacgttaccggcatgagcgccatcaggccgccgagcctgcggatatcccgcgttcccgtttcatggtcgataatgccggccgccataaataaacttcctttaaaagtagcatggttaattaagtgaaacacagccgcggtgacagccgccgtaaaatactctgaatgctcataatgaagcgcggcggctcctgcgccgagcatcgatacaatcataccgagctgactgactgtggaaaatgccagaatcgcttttaaatcggtttgtttaatcgcattaaaggaagcccataccatcgtgatcagaccgactgaggcaaccgtccaaaaccagacgggtgaaaaagcaaaaaccggactgaatctggcaatcagataaatacccgctttcaccattgtagccgagtgcagataggcgctgacaggagtcggcgcctccatggcatcaggaagccagatataaaacggaaactgcgctgattttgtaaaggcccccaataacaggagaaccatcgccggaataaagaacgggtggcctgcgataatatgcacctggttgaccatttccctgatactgaaagaatccgtcatcagatacagcaggataaagccgccgagcatgcacagcccgccgccgacggtaatcagcagtgatttttccgccccgtagcgtgatttcttccgcttatgccaatacccaattaataagaaggatgacaggcttgtcagctcccagaacatataaagcacgatgacgttatcgacgagcacaacgccgagcatcgcgcccataaacatcagcaggtacacataaaaagggccgagcttttctttgtccttcgataagtaaaaaatactgtaaagcgtcaccaaagagccgatgcccgtaatcaataaagcgaataacagcccgagtccgtcaatataaacggtatagttaataccgagggacggaatccattcggccgcataccggacggtttctccagccattgtgacagggagcttgctgataaagtaaacaaacagcacaacgggcactatcagcacaaaccagcctgtatggacttgttttacccgtttataaagaaagggaacgataaatgcaaataaaaaaggcgccaaaatcgcgaaatgtaacagctgcaacagaagacctcctttgcttgttttttcatcaagcaactgctttatgtaagaatgaatcaatcaattcacggtcataggacccagtacaaattatatcgcacttttttttaccctgctacggcataatgtattcctctttgtgtttttgtggtcttttgaacccaaaataaatttatcaaatatccggatctttgtatatacatttctttttcagatcaagctttacaaaaggagctggtcagatgaagagaaaggcggcggcctgtattggaatattttgttctattattgcaggaacattcatagttgatgatttctgcaaaacgcggcagcagacggaagcagatgattgggagcatttttttctcggtgcggaatacgcagaagacaagctgagtgcggctgaatcaatgcaaacgccgtttcagccgcgtgagtatatcagaatcgtatatagatgaaaagagttccggcaccagggtgcggaactctttttgtgtggcaatcagcgttttcctttaatataagggatgccgttggctttaggcgcatccgcgcggccgatgaagccggcaagcgcgagaatggtcagaatgtaaggagccatcagcatgtatacattcggaatgtctttgaacaggggcaaaagcgagccgataatgctcaaactctgcgcaaacccgaagaacagcgcagccccgagcgcgccgatcggatgccatttgccgaaaaccagcgcggcgagagcgataaagccttgtccggaaatggtggagtgcgtgaaatcaagcgcgatcgtggaagcatacacaccgccgccgagcccgccgaacagcccgctgatcatgacgccgatatagcgcatgccgaacacgttgattcccatcgtatcggccgccatcggatgttccccgacagaacggatgcgaaggccgaacggcgttttgaataaaataaaccaggaaacaaaggccagtacgatggctaaaatcgacgtataatatacgtctgaaaagaaaatctttcctaaaaccggaatatcgcttaacccgggaatgttcgttttgtaaaagggctccgggattttatcagtctgcgcctttccgtaaatcagtttgacgataaacagtgtcgctcctaacgcgagcatattgatcgccacaccggttaccgtctgatcggcgcggaaagaaaccgcggcagccgcgtggatcagtgagaacagtccgccggcaatcatagccgcagccagagcgagccacggagcggcggcgccaagctcgcgtccgaaaaataagttgaacatgacgcttgtaaaggcgccgataatcatcagtccttcaagaccgatgttgacaacccccgatctttcagaaaacacgccgccgagagcggttaaaataagcggagccgcatatacgagtgttgccggaacaataatggataaaatctgcaggaagtccacttacttcgccccctttttcttcaatttatcaaggatgagacggatggcgtagcttgatgccacaaacaaaataataatggcgatgacgatgtcaacgacttcagaaggcaccccggattcaatcggcatatttaatgccccgactttaaggccgccgagaagacatgccgccagaacaacgccgattgccgtgctgccgccgagaagcgcaaccgcaatgccgtcgaagccgacgccggtaaaggcgcccttaaccgccgcatattgaaaggttccgagtccttccatcgcgccggcaagccctgcgaaggccccggaaatcatcatggcgtacatcatattttttctgacgctcattccggcgtattgtgcggcgtgctggttaaagccgacagcccggaattcaaatccgctttttgttttatgaatgataaaccacatgaggactgccgcaaacagagcgatcagaatgccccaatgaaggcgggagtaatctgtcagctgctctaaaaacggcgagcggagcgacgcgctttcatgaattttgtctgttttgtcccggtggtccgtcatgacatcggaaatgagataattggttaaatgaagagcgatataattcatcatgatcgtgacaatcacttcgtggacaaaaaaacgggcttttaaaaatccgggaatcaggccccaaatgccgcccgcagccgcagccgccaataacgaaagcggaaggtggatgtaagcgggggcgtcaaaggaaacgccgacccacaccgcggcggtccagccgacaaggagctgtccttcaaccccgatattaaacaggccggtccgaaatgcgaatgccacggccaatccggacagaatatatggcgtaatctgccggatcgattccccgatgtaatacacttcaccgaaaatgccgctccaaagagccgaatacccgcttacgacattgtagccgctggcgagcatgatgaccgcacccgcagctaatccaaggatgatcgcaatcagcggcacagccagatgagaaagtcgattaatcatgtgttttccccgcctccatttgcttacttcccgccattaaaagtccgagctcctgctcgtttgtttcaagcggattgacgtttgcgatgatgctgccttcaaagatgacggcgatgcgatcgctgagattcattatttcatcaagttcaaaagataacagaagcaccgctttaccggcgtcacgctgctcaatgagctttttatggacgaattcaatcgcgccgacatcgagtccccgcgtcggctgggccgcaattaaaagatccggatttctgtccacttcccggccgataatggccttttgctgattccccccggagagagcgcgcgcaggcgtatattcatcaggtgtcctgacatcgtattcttcaatcaggcttcgcgctttgtcataaatcgtgtgtttatttaatatgccgaaagaagagtagggcttttggtaataactttgcagcacgatattttctccgatcggaaaatcaaggacgagcccgtgtttatgtctgtcctgcggaatatgcccgattccggcttcagtgactttcctgggcggcatattttgcagctgtttgccgtttaacatgatcgtgccggcatttgtttttctgagacctgtaatggcttcaattaattcagactggccgtttccgtcaacgcccgcaatgccgacgatttcaccggctctgacagagagggagagctgtttgaccgcctcaacgccgcgcgcgtctttcaccgttacatcagaaagcgaaagcacttcttgtttcggttcagccggctgtttatccgtcttgaatgacacttcgcgtccgaccataaggcttgccagttcatcttgatccgtatgtgcgacatcaagtgttgtaatgccttttcctttccggatgatggtgacacggtcgcagacttccataatctcttttaatttgtgggtgatgaggataattgattttccttcattgacaagatttttcataatctgaatcagttcttgaatttcgtgcggagtcagcaccgcggtcggctcgtcaaaaatgagaatgtcggcgccccggtagagggtctttaatatttccgcccgctgctgcataccgacggagatatcggcaactttggcttcaggatcaatgtgcaggccgtaacggtcggaaatatcacgcacgtcccgggcggcgcgctgtctgtcaattcggccgaaagttttcggctcttttccgagaatgatattttctgagacggtgaaggtatccacaagcataaaatgctggtgcaccatcccgatgccgagatcgttggctttgttcggactgttgatgtgaacgcgttcgccacgcacccggatctcgcctttttccggctgatacaggccgaataaaacgttcatgagtgtcgattttccggcgccgttttcaccgagaagggcgtgtatttcgccttttttcacttgaagcgtgacgtcatcattggcgacgattccgggaaattccttgcgtatattaagcatttcaatgatataatccaccgatttgtcgctccttttcagagatactttgatgagaaagagcttggcaaaagaaaagctgcaagagatgcagcttttccttcaccgctcttttcaaaaaagagaggggataagcacgaaagtctccttatcccctggttcttactcagccttgaaggatttcaattctttttcagttgaagggatcacgagtccgtccgcgattttcttcttccaatcgtctgttgctttgatgacatcgtcagaaaggttctccttgtgatccgagatgccgactgcatcttgcgccaaaccgtatgttaatgttttgccgcccgggaatttaccgtcactcgcttttttcgttaagtcctccacggcagtatccacttttttgaccattgatgtgagagtgacattgtcttttgttcctttgacttggccttccgcgtactggtctttatcgacaccgataacccatacgttccgcttcggatcttcttttttcagatttttcgcttctgtgaagacgcccgttcccgttgcgccggccgcgtgataaatgacgtcaacgcctgatttgtacatgctttcagccgtcgccttgccgacatcggctttgtcaaacccgcccgcatatttcacttcgacggtcgctttcggatttgcggcttgtacacccgcgcggaagccgatttcaaattttttgatcaattcggactccattccgcccacgaatccgacttttcccgttttgctcgatagcgcagcggccgctcccacgaggaatgaaccttcctgttccttaaatgtaaggctcgccacgttgtcttttttgacaacggcgtcaatgatcgcaaaatgtgtgtctttgcgctgatcggcgatttcgctgatggaatcctgcatcagatacccgacgccgtaaatcaggtcaaagtgttcccgcgctaatttatttaagttcgttgtataatctgcatctgattttgattgaagatagtcaaaaccgcttttgccttttttaagcccgttgtcttttccgaatgcctggatgccttcccaggcggactggttaaatgatttgtcatcaacaccgccgatatccgttaccatgccgacggtaaagtttttgctgccggagccgtttgctttgtcacttgaaccgcatgcgcttaatatggttccggccgctgcgatgagcgccatcgccattccgattttgcgttttttcaaagatataacccccctgtaaaatatggctgtgccgttcaattcagacttgagtccccgtgccggatgcagaatcgaaaaaactttctgataataatgatgagacgtctctctttttcccgccttgagcggctgtctcttccgggttcgggacttatgacttatctgaaaagatctgctaaccaatcataatttatcattttacccgccataaataaatagaaatttgcttattttttaaaaaatatcaattttatgaatcggcttcctcatctggttaaaacagaggaggatcagccgggtcattatccttatatagcatatcaaaaaggaatctcaagccttttgtcacgggatatgacagtaaaaaagcaccgttcacagcgaaacggcgctttttgacattataaatattgtttgatgctgctgacattgccggtgttgatatgatattgaaagacgggtctgccgatcgtgccgtacgccatctctacattcagcacttgtatgtcttccagaaatttaaggtatttccggatggagacttgcgagatttcagtatgcttggcgagatcttccgtggtaaaagagccgtcgccgaaagactcaatgctcgcccagatgagtttaagcgtgctctttgtcaatcccttcggaaggtgaaccttttccgccgcttctttcttttgaaaaagctcggcatccaattctttctgtgtcatgcttctgtgtgattgataaactttctgcttgcgtctgtagtcggaaagagcggtttgaaagcggtcaaattcaaatggtttgattaaataatcgacggcgccgtaccgaagcgtttttttaatgacgtccagctcgcttgcggccgaaatgacgatgacatcaaccgattcattctgcttgcggatttccgttaaaagctcaagcccgttttttcccggcatgtaaatgtcaagaaggatgagatcgatatgatgctcgctcagcacgtgcagcgcgctttgaaaggatgatgcgatccctttcagctgaaatccttcaatctggctgagatagcgcttatttaattcacccaccatggggtcgtcttcaactatgagtacattaatcatcattttcctccttcggttcatacggaatgcgaagactgaaagtcgttccttcattcttttcacttgtcacaatcatatggccttttaaattttctgttgcctgctgggtgaaatagaggccgaacccccggtttgtccctttcgtggaataaccttgttcaaaaatacgggcttggtctgccgcagacattccggctcccgtgtccgtaatctctatgtcaagctggcgatcctgaaaccgcatcgagcacgtaatgttttttttcggcatctgcgccaccgcgtcgagcgcgttgtttaacaggtttccgataatcgtaatgagctcatggatgacggccggatccgccgcattcggaatcaggctgccgagctgaatgtccagatcagcgccctgctcgcgtatgtagctttgttttcccagaagaaaccctgcgagaaccggacttttgacatcacttataatctcgcttgtttccgtcttctgctgaatggcaatgtctttaatgtaagtgccgagatcatcgtattcttttaactggacaagccctaaaatgacatgaagcttattcatgaattcgtgagactgggctcttaatgcgtttgcatacattttaacaccggacagctgttctgctaaatgtttgacctccgttttgtccctgaacgtggcgatcgctccgacggtttgtcctttcagatgaatcggaacttcattaaagaccagctcaagtccgttaatgcggatatctctgtcctgaagcggttttttcgtttcaatcacctgtttcagccggcttttcgggagaatatcgttcacatcttgatcgaccggattagtcggaatacccattttaataaaaagtcgtttcgcctctgcattggcaagcttaatttttccccgcgcgtcaaccgcaaggatgccttccttcgttgattcgagcatggcgctccgctcttccaggagggtggcgatttcataaggctcaagaccgtacataatgtttttgacggtgcgggcgacaatgacggctccgatgacgccgacaaaaatacttacgcagatgatgaaataaagcggtctcaaactgtggctgacgacatcctgtattttgttaagcgaaattccgaccgaaacgacgcccacttgttttttatcttttccatagatcggtacgaaggctctcatggattttccgagagttcccgctgatgtgctcgttttgatatggccgtgcaacgccggctgttcgtctccgccggtgaatttcttcccgattttatttgcgtcggggtgggtgaggcggatgctgttcatatccatcaccacgacaaattcggttcctgtcgtatgctggacatccagtgtataattccggagctctttcagcccttttcttgtttgcaatgcctgcgcgacactcggtgtttccgcgacaagctttgcggtgcgcagcgcggttgtccgttcttcttctttcacgcggtccgcggtctggacgctgatcgtgaaaaaggtgatacaaagtgcgataaggacgacaatacagacgaatatcgttaaccgggtttgcaattttaatgtttttttcataacagccttccttacgtttatcattcccgcgttctactttactccgaaaaagccggtttgtgaagatcaggcccttatttcgtaaaagtgaggaaaaatggaattttttatcttgtcaatgtgttttaagtcctccataataagtgaggtagattacagaaagggactttttatatgaaaaatacttattggacgggttattttccgctcgttgcgattctgctttttagttcgtcattatccatttctacctcgctttatgtcatgaagatacttcagacgctcggcatgtatcaggggatgctggattatttctctgagaaagggatcagactggcgctttttgcagcgttcgcccttgtgtattttatgcttttttcggctttgaagctgattgcaaacacagtgacagagctgtctcttttgtttttcacaaatgaccctgagggggacaatctgaaaaaaatcagattaggctctttaatttatgtaggcggaggaattctttcctttgcgttcgtgcagaatggtttttggattgcggcgttatttgccgttgttacgctcatttatttgattttcatggtgtacagaatctattcgacactctcgatcgtttcgctgatcggttttatattgcttgagattctgttttggtttacttttgttatcggtattttgtacatctttatcaagctttataatagcataatggctagcttacctgtgtaagctagccatttttgttaagacagaaatctgtttttgatctcaggggaggggagcatgcatgcttccctttttccgaaccatttgtaacggcgccgggcgatgaaagaataggctctgtccctgagggggcggggcactgcgaaaaaaaccgctgacagccgccaggctccgcggagatgacgcgaaacctttaacacggctgcggattttttgtatatccgcccgttttcgataaaaatcatgctgtcaaattgttctgtcggaagtccttctgatgccaaaagctcccgggcggtatctgattgcaatgaagcaaatgagattttgccggccggatcgcgtttaatgatgaattgaacggcgccgctgcataagttgcagacgccgtcaaacaaaagcacgcggtccggaagctgagctggtttcaaagcggatcccctccgttatctttaataagctgcctgcagcgtgtttttccagatcgaaagctgagggcttgcgtcatgaaggtattcgacgcttgacggtgtatccttgccgacccatacccccatcgtataagcgtccgtcaggccgacaaaccacatatcgtgatagtcatttgacgttcctgattttccgccgacgtacggagctttaaagttcgctttttttcctgttccgcttttgacgacggctttcatcatttctttgatctgcatgttggtccgcacgctgaatacctgcgccggctcatctttccattttaatatcgtttttccttttaaatcagtcacttttgtaatcgcgtgactcggcgtataaacgccgttgttgccgaacgtggtgtacgcattggtcatttcaagcggcgtcatgccgtttgtaaaaccgcccagcgccgcaggcaggcggtaatccgcgctgaccagcttcgcgaaatgaaacggttcaaggtagctgaacgccttattgacgccgacgcggtccatgattctgatggccggtgtgttgtacgagtatttaaacgccgtttccagcgtaaccgtgccgtatgtgcggttattatagttctgcgggcagtaatccgcactgcagaatttgcttgcgtcaattttgctgtgtggcgttgcgccggtcttttcaatgtaaggtccgtaatcaagcagcggcttaatggatgaaccgggctgtctgtatgcttgataggcgcggttgaaatcatatttatgataatctttcccgcctgaaagcgcgataatctgatgtgtctgatgattaatcacggccgctccgccctggacgcctgcatacggcagattttgattcacttgggcgacgacctggttttgcatatacggattcagcgccgtataaatcttcacgccgtcttttaacaatgtgctgactctgtcggaaagctcactctgtattttttgtttcgcctttccggaagctttttcaagacgtttgtcatagccttcggatgaggaaacaagctgtgtgaattcatcatttacataggaaacatagtcaggatatttatttgttttttcgtttatatcaagcttgatcttttccttttcggcttttttcagctgtttcccggatataacgcctgcttttttcaatccgttaagcaatctgacttgtcgttttttcgtataatcaaaatgcttgagaggatcatataatgtagggttattagggatggcgcagataaaggccatctctcccaaagtgagagatttcagcggcttgctgaaataaaattgtgccgccgaaccgacaccgtatacaccgttattaaaataaatcgtatttaagtagccttctaaaatctcatctttgctgtattttttctcaagctgataggaataggccagctccgtcagttttcggctgaaggtgcgttcatggcttaaatacacattccttgccagctgctgggtgatggtgctggcgccctggtcaattttatgatctttgaaattggaggcggccgccctgaccatccccataaagtcaaaccctttatgctcataaaaatggcggtcttcagaggttaaaaacagctgttttacctcattcggtattttattaaagggcacgatcacgcggttctcatgatcgctgacaatctcagaaacaaggcttccgtccctgtcatacatgtaactgttttgaaccaggttgatcgcttttaaatcaatatgtttatcgagcacctgatcaaaaggcttgatttgttttacctctttgccggaagcaataactgtaaatgcacacaacgggataatgccgagcagcaaaatccatccgattattttacgtaccatggtcactctcttttctcctgatttctagccatatcgtatcattcttttaagaatacgagaaggttaaatttagaagaaatcgtgatcgctgccggtcagcccgcatttgacgctgtatccttttgcagatgtcccgccatccataaaagccccgcgcctataaaaaagagaaaggcggtgacgtagaaagcagccgaaatagaaaaaccgcttgagaccgcacctccgagcagagggccgagcacgtttccgagaaaacgaaagctgacgttatatccgagcacctctccctggatgctgcccggagccctgacgcggatcgcggccgtaatgcaggggagcgtgccgcccatgaccatgccgaacagaaatctgaagactaacagaatggagagggaggaggcgagcgcctgcggaataaaaaacaccgctgatgcaatcaaaagcacgattaagatccggctgtggccgaagcggtcgccgaagtccccccatttccgggcaagcaataagcttccgagtccggtcgctgaaaacgccattccggagaaaaaggctaaattaacaggtccgtgcagctcattgacatataaagcgagcagcggctggatgctgaaattgccggtctgcacgatcatggtaagcaccatcatcgcccaaagcgcgggctggtgaaaaatataggagagcacctgttttctggaataggttttccgcttgttttgtttctcgccgagcggctgctcattcacctgaaataaaacgagaagcacagatgcgaaaatgacaaaagacgtaataaaaaatgtgtacgtaaatccgaagctgtcagcgagcagcccgcccagcatcggtccgaataaagtgcctgacacctgacccatctgcagcgtgccgagcgttttcccggcagtctctttcggcgtctgcgccgaaatcatggcaagcgaagtcggaacaaagcccgttacaaggcccataagcagccggaggacaaacagctgataaacggatgtcacaaaccccatcaataaaatgctgacggcaatgccggtgcctgtgatcaagagaatttttttgtagccgcgcttatcgccgaatctgccccaaaacggggaaatcacaaacgccattaaaaacgtgacgccgaacacatacccgctccatctctgcacatacccgcccgaatgggggctgatcgtttcgatatataacgaaagaaacggaacaatcatggtcatgctggcggaaataaagaaatttgtaatccaaatgacgacgaagttcttcttacggacagaaataacatcaccttctttaattttcgtgtgtctaatcattagtatataggaatgaatccggtatttgtattttcgatgcggatataggaaaattcattatttttagaaaatgaagaaagtttcagaggggaaactgatatactatcataaaatatcatttttgatcggaggaaaggcaggtgtaaaaaagtggatcagcgcagtctgctcattattgattttgaatttacgatgcctgacggaaaatacagcccgcaaaatttctttcccgagattattgaagcggggattgtcaagacggtgaatgatgaagtgactgaaacgttttcgagttatatcaaaccgaaaaaatttccaaagctgacgaaacgatgcaaaacctttctgaacatcacccaaaaagacgtggacggcggaatcacgtttaatgaattcatccgcaaattaaatgagcttgatcctgataaaaactgcacgatcgtcacctggggcaatatggatatgaaagtgttaaagcaaaattgcatgtttaaccacatcccttttccgttcaaaggagaacttcgggatctgtccctagaatataaaaacttctttggcgacagaacattgaccggcctttggaaagcggcggaagagtatggcgataaagggacgggcacgcatcataaagcgctggatgatgcgcggacgacatacaaattattcaagcttgtcgagcgggataaacaatatcttgaaaaaccgaaacccccgacgatcggtgatcgcgtcgatctgactgaactgtttcgacgggccacataaaaaaacccaatcatgccgactgggtcaagttcttttaaaatagtcacgctctaacgcggccaagttggcgagcgaacgttccgcccattctgagccgtccgctgtaagctgatctttcagccgggcagacgccgcttgtaaggaagccgtataatcaggaacttcgccatcaaacggtttgaccatctgatgcggtatgtttgtctgttccccgaatgcaagcgctcttctttcatgaaagaacggaacatccgcctgcttcggatgatgaagatctccttgagcgggatgcgtcagaacggctttaattttcactaaatagtgattgggcctgacgtctgtcacttcccctatgtatgctcctgttttataaaacccttttacgattgtgccgatttcaaacgaattcatagcgttcacctctctctagttattctataaaagatcaacgcgattggctagtgaacagctgccggaagcctgactgaagccgttgtgcccgagtgctcgccgctggtgaaatagacggagccttcatgatgctgaataatcgagaatgtcacggtaagcccgagcccggtgccattcgttttcagcgtataatacggtttgccgagtttctgcagttcttcatcggacatgccgattccgttatccgtaatctgaatgagaatcatctcttcctgtttttggacggagacctcgattcggccgttttcagagggcacggcttcaatactgtttttaatcagattaatgaaggcctgtttcagtttttttacatcgccgaacacatataaatcaggctcgctttgaacagtcacggtcaccgatttaaaattagcataagactccattaaggaacctgtttcctttacaagcagagaaatatcaaacttttctttttcatagtcatcctgcttcgccatatcgagataattcgtaatgatcgtctgagcccggtcgagttcggacagcacaagtttctgatatccggagtgggatttgtcctgaagctgctcgccgctgaacagcagctgcacaaaacctctgacgaccgtaagcggattgcggacttcatgggcgacgcttgccgcaagctcgctgacgacggccattttttctgagtgaatcagccttgcccgcatggacgcattctcatcaatgatctcaatcaaataaatgcacagcaaaagggcgctgacttgaaaaaaaacggatactgccgcctcataataaacggaagatagattttgaaaattgaaaatattggtcgcggaatagatgaagacagatgcggttaataaggcggtttcagtgcagccgatgagaagagcgaaaagcagtttcttccgctttgagaaaaaaggccatttcgtttggagctggatagggatgatgattaaaaaaggaattaaggataagaaaaaaagagcggaaggttcaaaccatatgagctgaaaaaaaacggatgctgcccctgcggcaagtcctgctgcggtaccggaataaagcaggcagacgataatgggaatcagctgcaaaccgtaacggacggaatgaagctcctggatgggaaaagccgtacataataaggaagatgacgctgcaaatacggcgaccagcaggcggttcgctctcggcacaagcaaatcgggcttgctgagccagaagacttgatagagaaaaatagggaataaaataaaagagaagtgaagcaggtaatcctttacaatctccatttatgcgaaatcctttcctatgtaaatatgaatctattataacatctttaccggcaaaaaaagtatttatttctctaaagcgaacgcccttatctcatctgataaaggcgttctttccgctgctaagagagcgctgctttcattctcttaagcccttcttttacggcggcggctgaacagccgacattaagtctcataaatccttcgccgcccggtccgtatttcgttcccggctctaatatgattttcccttttttgagcattctttctttgagctcggcatccgaaaatccgtatccgctgaaatccatccagatcaaataggaagcgtcaggtttcatcatgcggactttcggcaattcttttcttaaaaagtcctcagccaatttcatattcctttcaatgtaaggaatcagtgcgtcaagccaagggcctccctttgtataagccgcttcgattgctgcaaccgcaaatgtgttgaggctggaaatcccgttctgatgcaatgcggcggagaatttcgcccgcttataacggtcgggaatgataatggcggatgcctgaatgccggcaatattaaacgtcttgctcggcgcgacacaagtaatggaaatccgcgcaaactcctcagacagagaagcaaaaggcgtatgcggctttccgtacagcatcaagtcggaatgtatctcgtcagaaacgacggtgacgttatgagcggcgcacagcgatccgagctgcataagctcatcccggctccacgctctgccggacggattgtggggattacaaagaatcatcagcttgacctcagaatcgctcagctttttctcaagatcctcaaaatccatgcagtagacgccgttctcttcccgtaatgggttatgtaaaacctgccgtttgttttccttgatcatctgataaaaaggcgtatacaccggtgattgaatcaacaccggatcgcccggttcggtaaaggcttgtactgccatgctgattgccgtgacaaccccgggactgaacgtgatgcttgcgggatcgggccggtagccgtgccgtgtctcaagccatgaagcgacggcttctcttgtgttttcgtcaggagacgtataaccgaatatgccgtggtcaaggcgggcttttaaggcgtcagtgaccgcttcgggagcgcggaaatccatatcggcaacccacatcggaagtgcatccgatacgccgaataacgcttccgccttgtcccatttcaccgattgtgtgccaagacggttttctcgaagatcaaagttcatgtatgtcactcctgtagtatcattattttgcacagcgtatctatgataaaatagatttgcaaactttattataagcggtgatgaaaatggaagaaagccaagcggtcatggaaatgatgaaaatcattgccaagtgggacccatttaaatatggagaagatttttatgagacagaagccgtcgacatcgttcaggccgtctacagtgaagaccgtgccgacaagctggcagcagccattcaggatatctttgaagcttcatttgagcaaaagctaccgatcgaaggctgccaaaaggccgccgagcagcttctgttcataaaagaaagcagctcctgcaccccttaaaaaccggcggttccgccggttttttttattgaataaattcaaaaatccgttccgaaacaaactccgggcgctcttcgggtacgaggtgtcccgtatccttgagtgaatacagaatggaatccggcaggtcgtcatgaagccgttttccgactgagaccggaacgacccggtcttcttctccccatattaaaagagcggggttttgcactttcttcaaatcctcgggctctaaatcgccctccctgtgtctgatgaaccttgtcatcgctttgaaaatctggcggtctgtaaatggtttttcgtaaccgtcaatcatttcctgatcgataagcgtccggtcgtgaacgacatttaacaggtttttcagcacaccgtcttttgaaagccaatacttaagatacaggtcaaaacaagggaggtgcgtcccgaatataatcgacgggtgcgagcgctttaaataccccgagctgcacagcaggacgattttagaaaaaagctcgggtctgagaagagacgcggataaggaaatctggccgcccatcgaatggccgatgagtgcggcccggctgataccgagcttttccagaagtccgatcagaagcttggcgaggtttgcgtaagtatatacgaaagtccgtgacttttccgattgcccgaaaggaggcaggtcaacggcgataatatcataatggtttctgagcagcgggatcagttttctgaagctgaatgccgaagataaaaaaccgtgtacgcagacgagtgtctgtctgccgggattttcataatgctcgtaatacagttcaactccgtctatcgcggcccgtttaatcggtgaaacagcttccatgagagccttcgccgtcctttctttgttgtaatgtaaaggcttttttgattgtcagattttagttctggtttctttcgggtttttcttagcatttgtcgaaaatcgtgatataatgtcatgaagatttttgataatgcaaaggtgtgaaacgtatgaagctgacggaaaaagaaacagaaatattagaaattttagacgaaaacagccgcgttgatgcggaaacgatcgcgaaaatggcgaacattcccgccgaagaagtcaaaagcatcattgaaaagcttgaaaaggaaaaagtcatcattgattatgcggcgatgatcgactggcgcaaagtcgacggtttggaaggcgtcacggcgatgattgacgtaaaagtcactccgaaacgaaatgtcggctttgatgaagtcgctgaacggatatacagattccaggaagttgaatcagtgtacctgatgtcaggggtgtatgacttatctgtcgttattcgcggcaacacgatgtcagacgtggcaagcttcgtgtctgaaaaattgtccacccttgagtccgtcgtttccacgacgacgcactttatcctgaaaaaatataagcatgacggcaaagtctttgaaagcggagacgatgacaaaagaatcgtggtgtctccgtaaatggaaacgaagacttcttatttatctgactacgtgcagcagattaaaccgtcaggcatccgcaaattctttgatctggctgctacgatggaaggcgtcatttcactgggagtgggagagcctgactttgtgacggcctggaacgtgagggaagcgagtattctttctttagaacagggttatacggcttatacggcaaatgcgggtctttatgaactgagagaagaaatcagccgctatttagatcagcggttcggcctgagttattcgcctgacagtgaactgattgttacggtaggggcaagccaggcgcttgatctcgctgtccgcgccattatgaatcccggagaggaaatgttaattcccgaaccgtgttttgtcgcatatgaatcactcgtgaccctgacgggggcgaagccggtgccgattcagactgtagctgcaaaaggtttcaaagcatcagcagccgattttgaagcggccctgacggacaaaacaaaagcgctgcttctatgctcgccgtcaaatccgactggttccgtctattcgaaagaagagcttgaatccatcgcttccttcgctgaaaaacatgacttgatcgtgcttgccgatgaaatttatgccgagctgacgtatgatgagccattcacgagcatgggagccatccgcggcatgaaggaacgcacgattttgatttcaggtttctccaaagcgtttgccatgacggggtggagactcgggtttacggcggcgcctcccgtgatcagggatgccatgctcaaaattcatcagcacgcgatgatgtgcgcgccttccatggctcagtacgcggcgcttgaagggctgaaaaacggtcaggaagacgtcgaaagaatgaaaaaaagctaccggagacgccgaaacctgattgtggaaacattgaacgaaatcggactcggctgccaccaccccggcggagcgttttacgcctttccttccattcagtcgaccggcatgagttcagaagaattcgcggaacagctgctcattgaagaaaaagtagccgtcgttccggggaatgtattcggcccgagcggcgaaggctacatcagatgttcctatgcgacatccattgagcagattcaggaagcgctcgtcagaatcaaacggtttgttgaaaaaagggcataaaaaaagatacgaacccggttcgcatccaaataaaagggggggaatactagaaagccttcgtaatcatagtataccccctttatctgcgcttaaacatgatgatgtaaaaaagttctctttgcgaaaaacaaacttgtatgatataattttaaattgcgtataatctgtatttaatttaacttaggagttgttatgaatggcagcaaaatttgaagtgggcagtgtttacactggtaaagtaacaggattacaagcgtatggtgcgtttgttgcattagatgaagaaactcaaggacttgttcacatttctgaagtcactcacggtttcgtaaaagacattaatgaacacctttctatcggtgacgaagtacaagtaaaagtacttgcagttgacgaagaaaaaggcaaaatcagcctttctatccgtgcgactcaagcggcgcctgaaagaaaagaaagcaaaccaagaaaaccgaaagcggcacaagtttctgaagaaacatctgctccgcaaggtttcaacacattgaaagataagcttgaagagtggattgaacagtccaaccgcaaagaccttatcaaaaaataaccatcaaaaaaagcaccggatatgtatgttcggtgctttttttatgtttatctgacttccggatttgccgcttcctcgcgggatgtttcttcgttcggcttaaacagcaggccgagattgatcagaccggcgatgccgacaagaccgtaaataatccgcgacagagctgatccttggccgccgaagatggctgctactaaatcaaattggaaaaatccgatcagtccccagttaatagcgccgataatcgttaatacgagacagatacgctgaataacactcatgtaaacaacctcctctataaattcgtgaaacagttatagattgtgacaaagcaaagaatctatgcatactacattctccgccgtgtaaatcacacactgtctcaagctgtacaagtgcctttcccgggaaaccgctgtctgtaaaccgtgtgatgtgccgtcaaaaaagcggattgctttacattgaacgtcaactttctgcataatataaatccaaaggaggagatgtcatgcaaaactttacatattggaatccgaccaaattgattttcggaaagggagaggtcgaaaaacttcctgaagaaatcaagccgtacggaaagaacgtactgctcgtatacggaggcggcagcattaagcgcagcggtctttatgatcaagtaaccgacctgctgaaaaaagcaggagttaccgtacatgaattggcaggcgtagagccgaatccgcgtgtctcaacggtgaacaaaggtgttgcgatctgtaaagaaaacagcatcgatttcttattggccgtcggcggcggaagtgtcattgactgcacgaaagccatcgcggcgggcgctaaatatgacggcgacgcgtgggatatcgtcacgaaaaaacaccagccgaaagaagcgctgccgttcggaacagtgctgacacttgcggcgaccggttcagagatgaactccggatcagtcatcacaaactgggagacacaagagaaatacggatgggggagcccgctcgtttaccctaaattctctattctcgatccggtaaacacatttaccgttccgaaagaccacaccatttacggcatggtcgatatgatgagccatgtgtttgaacaatatttccaccacacgtcaaacacgccgtatcaggaccggatgtgtgaatcgcttctgcgcacggtgattgaaacagcgccgaagctgatcaacgatctggagaactatgagcttcgtgagacgattttatatacaggcacgatcgcattaaacggaatgctgtcaatgggcgcaagaggggattgggccacacacaacatcgagcatgcggtatcagcggtatacgatataccgcacgccggaggtttagcgattctgttcccgaactggatgagacatgtgctcaaagaaaatccggcccgctttaaacagcttgccgtccgtgttttcgatattgacgagacaggcaaatcagatgaagagatcgcacttgaaggaatcagcaggctgtctgaattctggacgagcctcggcgctccgaacagactcgctgattacgatatttctgatgagaagctggatacgattgcagataaagcgatggcaaacggagcattcggacagttcaagtcactgcagaaagaagatgtgcttgcgatactgaaagcatcattgtaataacataaaggggggcggccggattggcagctcctttttttctgtgttatagtaattcccttacgatttttttggaggtcatgataaatggagaactttacgtactgcaatccgacgaaactgattttcggaaaaggtcaaatcgaccaattgaaaaaagagctgaagcaatacgggaaaaacgtgctgcttgtttacggaggcggcagcattaagcgaaacggcctgtatgaccaagtaacaggcattttaaaagaagaaggcgcagccgttcatgaacttgcgggcgttgaaccgaacccgcgtctggaaacggtaaataaaggaattgagctgtgcagacagcatgagattgatttccttctcgcagtcggcggcggaagtgtcatcgactgtacaaaagcgattgcggccggtgcgaaatatgacggcgacgcatgggacatttacagcaaaaaagtaacggcgcaggacgcgctcccgttcggcacggtgctgacgcttgcggcgacaggctctgaaatgaaccctgattccgttatcacaaattgggaaacaaacgaaaaattcgtatggggcagcaatgtcactcatccgcgtttctccattttagatcccgagaatactttcagcgttccggaaaaccaaaccgtatacggcatggtggatatgatgagccacgtatttgaacaatacttccacaatgttgaaaacacgccgcttcaggacagaatgtgttttgcggtccttcagacggtaattgaaacagcgccgaaacttttggaagaccttgagaactataagcaccgcgaaacgattttatacgcgggtacgatcgcattaaacggcacgctgcaaatgggctatttcggcgattgggcttcccatacgatggagcacgccgtatcagcggtttatgacatccctcacgcgggaggacttgcgattctgttcccgaactggatgagatacacgcttgatacaaatgtggaccgttttaaaaacctcatgcttaatatgtttgacattgatactgaaggcaaaacggataaagaaattgcgcttgaagggatcgataaattgtccgcgttctggacaagcctcggcgcaccgtcccgccttgcggattatgacatcggcgaagacaagcttgagctgatcgcagacatcgccgcaaaagaaatggaatacggcggattcggcaatttccaaaaactgaacaaagatgatgtacttgccatcttaaaggcgtcactgtaagatacattcccggccggagtgattttcaagctgcagatgtaaccgttttgggagtccctctttccggattttctattagttcattaggagcaagtgaaacacccttttccatgagacaactatggaaatcgtttcatccgtaaaggaccaattaactttgcgattgtctgtcatctatttacacgaaatctaaatcacgaagatgaagagccgcgaatttaaaaaaggggcgctgattcaatcagcgctcctttttatgcattttgtgtactaaggtcccgctgcgcccccatatagcttcccattaagttttgataaccgggaagatgactggagactaatgcgccaaaaccttcaacatcgttgcgccaatcacgctgaagctcgcatgctgtgctgaaccagttcataagctgcacgccgccatgagccatacgggttaatgatgcatctgctacttgcttattaaacgtccccgaagcatctgtcacaacaaacacttcgtagcctgctttaatggcagaaagcgcaggaaaagcaacgcagacgtctgttaccacccccgcgataatcagctgttttttgccggtcgcttcaatggctttaacaaagtcttcattgtcccatgcattaatttgtccgggacgggctatttttggcgcatcaggaaagagatcaacgagttcttgcatgagcggtccgttgggtccattttcaaagctggttgttaaaataaccggtaaatcaaagaatttagccgtatcaccgagagccaatacattgtttttaaattcatcaacgccatagtcacgcacgagaccggaaataaggccggtttgatggtcaactaaaagcacggcagaatcatcttttgaaagacgggaataaagatcagacattttatcatcctccttgaattaaggcaagtcagtttgtcaatggaaaacggtaaatctattcatatactgtataggtagaaagttatttctgaagtgacttttcgtgaaggtgatgatctttcaattaatccggaatgggaaccggagcatgatcaatccaatggatgaactgttgtaaatagcgttgaagataacgttttgtttgttcatccgtaagtatgtgttgagcggaatcaattttctcatggacttgcgaaatcagcattttttgaaagggcagaacattgacttgcatagcttcgagtacttctctcgtttgcatttgaccaaaagaggtgccgaaccctccgggggttgcgccgattaagccaaccggttttctgtttaaaacggaagaggtccgcggtcacgatgcccagtccaatgcattttttaatacccccgggattccggaattgtactctggacttacaatgatgacgccgtcaacgtctcgtatatcagctctaaaggatgttacggagtctggtgctccggccatttctaaatcttcgttaaaaaaaggaagagtgtctatttcaacccagcgaaattgagccgcattatcgaagtcaatcaatgattgagcaatcactcgattatacgagttttttcgtaaacttccacaaataagaccaatggttttagtcaaagaatcacctcccggtttaaaattattttcatcttaacatgataacccaaatatagacactatttttaaaaatggacatttataccttaatatgcctgcttagcagcctctcaagaggagtactatataaaaagaaccgtcccatcggtattggcgatggatgtcaacctgctccaaagtaaaggtgatacgttcctggatcaccaacattcgattcgttacctctttcacgattattacaaatataactatttcgaatccgggatattgtataaaaaatgagcgcatcttcagcgcaaatcccgtattcatcatgccttcttcatgacttgatttagcgggtgagttcatataaagtgaaagagaaaacaattcaccgtgatggagggacaagcaaatgacgcatgtacgctttgattactcaagagcgttaccttttttcaatgaacatgaacttacatacgcacgtgatttcgtaaaaacggcacaccataatatccatgaaaaaacaggcgccggaagcgactttttaggctgggtggacctccctgaaaactatgataaagaagaattcgcgcgcattaaaaaaagcgctgaaaaaatcaaatcagattctgacgtgcttctcgtcgtgggtatcggcggttcatacttaggcgcccgcgcggcgattgaagcgctcaatcattctttctataatgttctgccgaaagataagcgcaaaaaccctcaagttatctttatcggcaataatatcagctcaacttatatgaaagatgttatggatcttttggaagacgctgatttctctatcaatgtcatttctaagtcaggcacgacgacggaacctgcaatcgctttccggattttccgcaaacttcttgaagaaaaatacggaaaagaagaagcgaaagcgcggatttacgcgacaacagataaagaacgcggcgctttaaaaacgctttctaatgaagaaggcttcgaatcattcgttattcctgatgatgtcggcggacgtttctccgttctgactgcggtaggccttctgccgattgcggtaagcggggctgatatcgatgaaatgatgaaaggcgctcttgatgcaagcaaagacttttccagctcggaattagaagagaacgcggcttaccaatacgccgtcgtccgcaacgttctgtataataaaggcagaaccattgaaatgctcatcaactatgagcctgcgctgcaatactttgctgaatggtggaagcagctcttcggcgaaagtgaaggaaaagacgaaaaaggcatctatccttcttccgctaacttctcaacagaccttcactctctcggtcaatacgtgcaggaaggcagacgtgatctgtttgaaaccgtattaaacgttgaaaaaccgaagcatgagctgacaattgaagaagcggaaaatgatctcgacggcttaaattatttagccggcaaaacggtcgatttcgtcaacaaaaaagcgttcgaaggcacgatgcttgcccatacagacggaaaagtgcctaacttaattgtcaatattccggagcttaacgcatatacatttggatatctcgtttatttctttgaaaaagcggtggcgatgagcggttatctgctcggagtcaacccgtttgatcagccgggtgttgaagcctataaggtgaatatgttcgcgcttctcggcaaaccgggctttgaagagaaaaaagcagagcttgaaaaacgccttgaaaaataaaaagaagggctggccctcagcatgacgggtcagccttttttaaaccgtgaaaggtgtgatgatgaattgatgcggcttttatgtaagcatgtcttcatttccgtctgttccgccgctatcgtctattcggcactaaaactgtctcccgaatccctcttgcaaaccatcctgtttttcgctttccctctcggcttgtttacggacatggtccggctgaaactgaagattggccggatgcatacgctgatcacgaagtgctgtctctatgccgccgttttctatatttcaacggaagccgctctctccgcaattgtgacgtatgttctgattgaatgcgccgtcacctcttttcagcgtctgtctgccgctcccggttcttcccggacgccgtatgaagataccgcagagcggggacgctaaagacaaaaaggagcatatgcacatgatcagcataccatcttcacttgaaggtcaatcgtttttactccgcgaactggaacaggtgatgaaaccgatcggttataccatcggaggcggctgggagtatgaccgcgggttctttgattacaaaatttccgatcaggacggctatttatttctccgtatccctgttgaagcaaataagggacacctggatgaacggggggccgccgttacaatcggcacaccctttttgctgaggcacgtttatcagcaggaaacggatgatgcagcaggcggcggtgtttttgagtcattattcaaccaattctccgaaccgaaacggcgggatgcggcaattgaccgctcatatacagatatcggcatctcgcttgtgaaagagctggaagacgtcctgctgcattaaagagccaaaaacagatcagtatcgagcacctggtatgacaggggaggggtcagcatcggcccctcttctttttgtatgccgatgatcgtggtattccgtctgagataatagagcgcgcagtcatgataagatgagccctttagttcctcggggacgggaatgatgcgcacctttttctccagcgtcagatctgacagcgtttgcggtttggcaagctgcagcttgacccggtaatgctcaaacatcacccggctcgacaggtgtgatgtgcacagaatcttattggctcctgcgcgctcggcgtttttgacataccgttccgttaaaatttctacgatacaataaacagacggatgcagccctttgatggcgagaagcgttaataccgacagcatatcagcttcggattcatttttctgctggtccgctgtcagaatgacggtatcagcttccgtaatattcgccttattgagcgtgctgtcatcagcggcatgtccgcggatgaaatggacgttttcaataagcggaccttcccttaatgaatcatcaatcaggacgacagtttttgacggtgcgatgtgctgcagctctttcagcagcatatgcgatttttcgttccatccgataagaatgacgtgccccttgcctttaaaggcgaccttcccttcgacatagcggtgctgtttgctgaacacggctgaagaaagcgtggcgaaataggcggtcacaaaactcgctccgcttaatacaagcaccatgccggcaatctgcccgagcggcgtctgcggaacgtaatcgccgtagccgactgtggccaccgtaatgaccgcccaccaaaccccttcaaacacagacgtgaattgcttcggttcgagcatgtaaatgagttggccgaacaataaaatcaaggcgataatgatcagcccgatccgaacatataacggccatctcagccaggaaataaaaatacggtttgatttcattcgtccggctcttctttcgacagagagatggataaaatctgcttaataatggtgtttagtttttcgtccagctgttcctggccgtatgagtcacgcgcatgtctgattaaatcggccgtctcatcttcaaactgaatgagaggttcgtcgttttctgattcattatagagctggatgaaggcgtcaagcccttcgttcattctgtctatcgcattgctcagctgttctttctcgccatttgtcactttcatgtcgatcacacctgtatctttttttatacagtatgtcccagttcgtttgatgtctttcaaaaatcgccgaaaacatattcacccttattttttcatatgataaagaaagcggaccgaaaaagggtgagtcaaatgacggtcattcaaaaactgttggcggcgctggccggagcgcagctgcttgcttcggcggccgtattgcttattttcgatttgaatggatacaatcacatgtccggcggattttcatggcttgtttttgcaaaagagaccgcaggcacgtttccgttttacatcggaatggccgggtgtatcctcatcatgctcggaggattgattcctgtcagaaaaaagaagcggatttctgtacaggaaagcgggcaatcattaaaataatatataagcagatcgtacgatataagagaaaaaggaagaggataatatgctgtttatctttttaacaattgctgcattgggtttgtcgttttgggcacaatttaaagtgaaaagcaattttcagaaatactcagacgtggaagcctccagtcagcggacgggggcggaaacggcaagacggattcttgatattaacggtttatatgatgtgccggtagaaccggtaagaggcactttaacagaccattacgacccgacggagcgggtggtgcgtttatctgagccggtatattacggccgctccatttccgccatttccgtcgcttcccatgaagtcggacatgctttgcagcatcaggaatcatacggcgcgcttgtgctgaggcacaaaatttttccggtcgtcaattttgcctccggggtcgcccctctgcttttcttgggcgggatgctcctgggcagcttgaacttaatcggactcggcattattttgttttcggccgctgtttttttccagcttgtcacactgcctgtcgagtttaatgccagcgcgagggcgaagcggattatcgtgtcggaaggattcattcgcaacagtgaagaacacggcgtgaataaagtgctgaacgccgccgcgctgacgtatgtggctgcggcgctcgtttcattattcgagctgcttcgttttgtgatgattttcttaaatggtcgtgatgagaattaacacgaaggaggtggccccttaccgtttgcggtaggggtttttttgcttatattaaaactgattctcattatgctgttaatcggattaacggccatctttgtcgctgcggaatttgcgattgtcaaaatccgcggttcaaaaatcgcggagctggttgaaaccggagacagccgggcgctcgcggcgcacagggtgatttcaaatctcgatgaatatttatcagcgtgccagctcggcattacgattacggcgctcggactcggctggctcggtgaaccgacgattcagcggcttcttcatcctgttttcagcctgatcggaatgccgtcatctattacgcacgtcgtcacgtttattgcggcgtttatcgccgtcacgtatctgcacgtcgtcatcggagagcttgcgccgaaaacgatatccattcaaaaagccgaagctgtcagtctgtggacggcgaaaccgctcattctgttttataaagtgatgtatccgtttattaagctgttaaacggctcagccggatttttggtcaagctgttcggttttcattcggtgaaagaacatgaggtcgtggtcagtgaagaagaattgcggctgattttgtccgaaagctataaaaaaggtcaaatcaatcaatctgaattccgttacgtcaataaaatatttgaattcgataaccgggtcgccagagaaatcatggtgccgcgcaccgaaatcgccgtcatctcgcttgaacagtcagttgatgaagccatacatttgatcatcaacgaacggtatacgcgatatccggttattaaggaagacaaagatcacattctcggcattattaacaataaggatttatttaaagcgtattttctcggccgctccattgaattaaaagaaatgatgcgtccggtcatcagagtcattgaaagcatccccgttcaggagcttttgatccgcatgcagaaggagcggattcatatggcgattctcgttgacgaatacggcggcacggcgggacttgtgaccgtcgaagacatattggaggaaatcgtcggggaaatccgtgatgaatatgaccaggatgaaatgccccacatcgtcaaaaaaggcgaacaccattatgtgatggacggcaaggcgctcatagaagaggtgaatgatctccttgatatcgccatcgaaaatgaagacattgacacgattgccggctggctcttaacacaaaaaatggagctgaaaaatggtgatgtgtttcatgccgaagggtgtgaatttaaggtgctggaagcggaagaccatcatatccgcttcgttgagattaaaaaaactgatttctgagcctcctgcttttgcaatgaggctttttttatggaaaaaatgcttcttcgtcccgctccttcatatgctgtaaagaaaggagtgtcggtatgaaaacggattggtggaaaacggcggccgtctatcaaatttatccccgaagctttatggattcgaacggggacggaatcggcgatattaacggcatcagagcaaagcttcattacataaaagagttgggggcggatgtgatctggctttgtcccgtttttgactcgccgggcgcggacaacggctacgatattcggaattataaacaaattgccggcgaattcgggacgatgaaggattttgaccggctccttgcggatgtccatgcgctcggcatgaagctgattatagacctcgtcattaaccatacaagcgatgagcacccttggtttatcgaatcacgctcagcgaaagattccgaaaaacgggactggtacatctggagagacggaaaaaacggcaaagagccgaataattgggaaagcattttcggcggatcggcgtgggaatatgatcaagagaccggccagtattacctgcacctgtttgacaaaaaacagcctgatttaaattgggaaaacgaagcgatgaggcagtccgtttatgagatggttcgctggtggcttgataaaggcatagacggcttccgggtggatgccatttctcacattaagaaaaaagaagggctccctgacatgccgaacccggacggtctcccgtacgtcccgtctttcccgtatcatatgaatggggaaggcataatggatctcttaaaagagctgaagcgggaaacattttcgcgctatccgatcatgacggtcggcgaggcgaacggagtggcggcttgggaggcggctgattgggccggtgaagaaaacggcgtctttcaaatgatttttcaatttgaacatctcggcctctgggatacggaagatgatcaaagcatctccattccggcgcttaagcgcgtcttgtccggctggcagtacagccttgaaggaaagggctggaatgcgttatttatggaaaatcacgaccagccccgttccgtttcggtatggggtgacgaacggtttttgacagaaagcgccaaggcactcgccgtgatgtatatgctgatgaaaggcacgccgtttatttaccagggacaggagctcggcatgaccaatgtttcgttcccatccattgaagattatgatgacgccgcaattaaatatctgtatgaaaaagagacgtcccgcggcgttccgcatgaacaagtgatgaagatcatctggaagaagggccgggataattcacggacaccgatgcaatggagcggtgaggcgaacggcgggttttctgatgcttctccgtggctcggagtgaatccgaaccacacatggctgaacgctgcatcacaattgcaggatgaaacatccgtataccatttctacaaacggctgctcgccctcagaaaaaaacacggcgtattgatcagcggcacatatgaattgctgcttccgaatgaccggcagatttatgcctatctaagaaaaaacggaacaaaaaccgccctgatcatcaccaatctgtcccgaacccccgctttatacaggcatcccggttatccgcttgactccgattctctcgtgcttgcaaacgtggaaacagaatcgcaccgccatgtgacatccttcctcttaaagccttatgaggcccgcgtatatatatggtgaaaaacttcagtcccgaggctgaagttttttgtgatctgtgtttatcatcgcgatccgacaggaaaagacaaatacagaaacgaatatgggaaaggaagagaaaaagaaaggaggcattcatatgctgaaaaaattgcagattcaaacaaacaaaagggatgaaatgatcgacatcacacatgaagccgaatcgtttctccgcgaaacaggcgtaagaaacggtttggcgctcatatactgtccccataccaccgccggcattaccatcaatgaaaatgccgacccggatgtgaagagggatatgctcagaaggtttgatgaaatgtatccgtgggagcacgaactggaccggcatatggagggaaatacggcggcacatatgaaagcgagtacaaccggcgcctctcagcatgtcatcatagaagacgggcgcctgatactcggaacatggcagggcgtttatttttgcgaatttgacggtccgcgaaacagaacatgttatatcaaaatactggctgaaacggaggaaaacaaatgagtgagtggatgagtccgttatcattaacaaagcccgtcattcaggccccgatggccggcggactggtcacgccgcgtctggcttcggcggtatcaaatgaaggggcgctcggaagcctcgcttcaggatacgtcagcccgcaagcgcttgaaaaacagcttatcgagatgaaagagctgacggaccgctcctttcaagtaaatcttttcgtcccggaagaaagacagatgcctgaggcggaacttgttgaaaaatggaaagcccgcattccgagggcaaaagacgccaagccgttctctgatctgaaagaagaatggaatgatttcgcggaaaaagcggagcttctgatccgttacggagtcaaagcgtgttcattcaccttcggcctgccgccggaaaaaacggcggaaaagctgaagaaaagcggttgtttccttttcggcacggcgacaacgccggaggaagcgaaggcttttgaagaacggggaatggacgccgttatccttcagggaatagaagccggcgggcatcgcgggtcgtttctgccggttaaaggagaaccggctctcggccttatggcgctgattccgcaggctaaagacacgctgaatatcccggtgattgcggcaggcggcatttttgaccgccgcggggtgcaggcggcccgatgtttgggtgcggacggcgttcaagtaggaacaccgtttctcctttgtgaagaaagcagcgcctcaccggcatatcaaaaagccattgccgaatcaaaaggagccgatacgcggctgaccaccctgttttcaggaaaacaggcgcggggaatcgtgaatcagttcatgaaaacatatgaagctgacgagggaaaaacgctgccttatccgctgcataatacgctgacaaagccgatgcgcgggcacgcggctcaatcaggagacgcggagcatatgtctttatgggccggccagtccgccgcgaaacttgaggggccgacagacgtgaaaaccgttttggacagattgtgcgaatcataatccagaaatcgtgaggtgatggatgatgaagattcttcaaatgtcctataaaaaaagagggactattgagtttgtctttgaagattttccgcattccaaagtcaccatggcgccgattaaagggtattactttgtccgcgccattaaatggagcagacgggacagagccgtcacccgccatgatttagagaagtttgaatgggctgcaaaccaagcgctcggcacgacggctttttaccggaaaagaaaagcatttcacatcccatcgtcacaatgacagacgatgggattgttttaatgcatgatctgataaagcgcgggtgcatcaagccttgttgcctggttaagcagataagccggctgcacggcatttttttttcttaaagaattcaatctctggatgatttgttcagcggtcagaatcccgagaccgtgggcgaaatattgatcattccccatcacaatgacattttctccccgccactgagcctttgcagggttaaaatcaggatttttaaaatataaacagtctccccgtaaaaagtggctgccggtttccgtgtagatcggcagatgctcatagtgccagtcatacaaagtgatatcccggaaacgccggttaaaccgttcttcaccgattgtctttaagacggccagataataaatcacaacaatggcggtagcgcattcaaatgcgtaaaacgccccgttttcaataatatcccgaatcgcttttgaagcgggaatcctgtacttcagctccagggctccttccggcgtcagtctccaataagccgtatttccgtatgttttggcgaaagttgcaaatttcacacctgatccgtgcagttctcttgcggcttccacaatatggcggcgcagccgcacctcgaacatcagttcagcaatcgacccgtaatcgaattgtacgggagaattgagcagttcatttatatacggaacaaggctttcttccgtctgccagttcgcgatgtcctgaggccgaagcacttggccggatatgataatcatctgcgcgccccctatctttttttataagatatgcaggaagcttgggcaatgaaaatcaagtgataaaaaaggaggaaatgttaacaaaatgtgaagactgagccgatatataaggtatcacacttgagggagcagcttaatatgaaaaaattcattaattggtgcacaaaggcatcgatttcacggaaattaatcatttcatttatcgtgatcttaatcataccgattctcgtgttagaattcagttcataccatacggcgagcaattcgctggatgatcagatttcaggcaacgcgaaaaataacatcgaatcttttaacacaacgattacaaatgatatcggcgcaaaagcaaaggcgattgaatttttcagtgaaacgttaaaaggatcatccttctcaaagaaaaacatgtctgctcttgaagaaaagttcgggcaatacacgtctattcataaggacgtagcccgcatttacggaggaacggaagacggcagctacgcacaggcgccgaaggaaaatactccggccgattacgatccgagaacacgcacttggtataaagacgctgtgaaggccggcggcacgctcgttgtcaccgacccttacaccgcggcaagcgacggcagcatggtcattaccgtggcaaagcagatgcaggacggaacaggcgtagtggccatggatattacgattgaccagctgctgaagcagatgcagggaatcaaaatcgggcaaaaaggattcgtgtttatcacgtccaaaaataaaacctatgtcgcgcataaagaccacaaaccgggcgataaagtttcaacgccgtggctgaatgaggtatacagcaaagacagcggcattatttcatacaagctcgatgatcaaaataaaaaaatggcgtttacgacaaataaactgaccgggtggaaaatagaggggagcatggagctcaacgaaattaaagatgcctcacaaccggtgctgacgatggggatgattgtccttgcagcatctattatcatcgggggaattttaattctgttgattgtcagatccattacgtcaccgctgaaacggcttgtccgctcttctaaacaaatcagcggcggagacttgactgaaaccattgacatccgctcgaaagatgaattgggcgaactcggcgcgagctttaatgaaatgggagaatctttgcgcggactgatcagcgcgatccaaaactctgtcgataacgtggccgcgtcatcggaagagctgaccgcttcagcttctcagacaagcaaagcgacggaacatattacaatggcgattgagcagttttcaaacgggaacgaagagcaaagcgaaaaagtcgattcaagctcagccaagctgaatcatataaatgacggactcgccgccgtttcccgcacatcatcatccattacggaggcatctaaacaatcgaaggaagctgccggcaccggggaagaatatgtgcagcaaaccgtcgggcagatgaatctcatcaatcaatcggtccagcaggcggaagcggttgtaaaaggccttgaggccaaatcaaaagacattactcatattttaagagtcatcaacggtattgccgatcagacaaacctgcttgcattaaatgcagccattgaagcggcaagagccggtgaatacgggcggggcttctcagtagtagccgaagaagtgagaaagcttgccgtccaatccgccggttctgccaaagagattgaaaaactcattcaggaaatcacggctgaaattaatacttcgcttcacatgtttacatccgttaatgaagaagtgcaatcaggacttgccgtaacggatcgcacgaaagaaagcttccagaatatcttcggcatgacgaacgacatcgccgaaaaactgcaatcaatgaacggcacggttgaacagctgtcagacagctctcagcacgtttcagccgcagtgaccgatattgcggacgtatcacgggaaagcgcagcaagcattcaggatattgccgcatccgcagaagaacagcttgcatcaatggaagaaatcagcacatccgccgatactttggcgcaaatggccgaagaactgcgggaattaacgaaacaatttaaaatcaactagtaaaaaaggacgctttccaggtggaaggcgtccttttttatagtgacagccggataattaaataaaaagtcttgcatacaaagggagtacatagaactatttttcatttatgacttaattttcaatgtaataaaaagggagtcggccgatataaacagtaaatgattgaaagaggtttacaaaattgaaaaaaacagcaaaaaaaatcgccagaaaatcaatagccaaaaaacttatcatttcatttttactgatcttaattattccggtagcagtattggccgccggcgcctaccgttcggcggcttcatccgttgaaaagcaaatgatggaaagcgccgaaggaaatgtgcaaatcttaaacaatatgattgatgaccggatcggaatgtttacaaaaagctctgcatatttcagcgaatgggcgacaagcgctaaatttaaagaaaaaaaccaaacggaaatgcaagaaaggtttaaacagtttattgaaagcaatgataaagcgtccgccatattttcaagcagcaaggaaggaacgtttacccgttatccgcatgccgatatgccggccgatttcaatccgcttgaaagaagctggtatcaggaagccatggagaataaaggccaaaccatcatcacggacccttatgagtccatctcaaacaaaaagatggtcgtcaccatggcccgcgcggcgcaagacggatcaggcgtcgtcgccattgatataaaaatcgacgatctcatcacgatgacaaaagaagtgaacatcggaaaagaaggatacgcctttatcctcagcaaaaataaaaaagccgttgcctacagtgatgaaaaagccggcgcggcggtatcgggaaaatgggttgatacattatacagcgggcaaaaaggcgactatgaatatacgctgaacgggaaagcgaaaaaaatggcgtacgtgaccaatgaagcgacgggctggaagatcagcggaaccatgtccgtggatgaaatcaaggatgcggcaagaccggttctgactctggccgttatcatattggcgatagccgttgccgcagggatgattttcatttattttgtcatccgctcaattaccaaaccgttaaaacgtctcgtagcttcagcggaaaaaatcagcagcggagatctgactgaaaccattgatgtcagctctcaagatgagctcggcgtgctcggtaaaagttttaatcatatgacagattcactccgttcgcttattcagggaattcaggactctgttgaacatgtcgcttcttcctcagaggagctgacggcttcggctgagcagacgagcaaagcaacggaacatatcacccttgcgattgaacagttttctaatggaacggaagaccaaagtgagagtattgataaagcgacagcacaagtgaatgagatgaaagacgggctcagcgatctggcggaagcggcagccgttgtgacggaaacttcaattgaatcggcggagatatccggcgccggtgagcggcttgtcaagaaaacagccggccagatgggcgccattgaccaatccgtaagtaaagcggagcaagtcgtacaagggcttgaactcaaatcgcaggacatcaccagcattttgcgcgtcattaacggcattgccgatcaaacgaatctccttgctttaaatgcagccattgaagcggcaagagcgggagaatacggacgcggtttttcagttgttgccgaagaagtgagaaagcttgccgtccaatccgccgattcagcgaaagaaatcgaatccttaattcatgaaatcgtcaaagaaattcatacttcgctcggaatgctggaatccgtcaatcacgaggtgaaaagcggacttcagttaacggacgaaacggaaaaaagcttccgggacatttccgctaaaacaagtcagattgccggtgaactgcaaaatatgaatgcaaccgtggaacagctttctgccggatctcaggaagtatcaaacgcttcagaggatatcgcggcagtctccagacaaagcgcggccggcattcaggacatcgcggcttcagctgaagagcagcttgcgtccatggaggagatcagttcctcagccgtcacgctggaaaaaatggcggaagaattacgcgaactgacaaagcgttttaagataaactcttaattaagtctaaaagactaattttgcaataggtaaaaagtatgtttcgttatatttcttctttttggatgtgtatatttacccataattgccgatatgaagggtaaacacgcaagaggagatatagcagatgaaaaaaattgtgcaaatcatcaagcagagatcgcttacaagaaaactgctcatttcttttttggccattctcattcttcctatttcaacgctggcttttatcgcctatcaatcggcggtaagtacgcttgacaggcagatgatgggaagcgcattagataatgtgcagcagattaacgatatgatcaacacaagcatcagccaaaaggaagacggaacggcatatttcagcgactggctcacaaaggatcggtacaagccgaaaaaccaatcgcaaattaccgataaattcacagagtacatgaagattaataaagacgtggaatccatctatacgagtgacacggaaggacatttcacacggtatccggatctgcagatgcctaaaggatataatccgcttgaaagagactggtataaaaaggccgtggaaaataaggggaaagttgttgtaacagatccttaccgcacggcttccaccaatacgatggtcgtgacggtcgttcagcagacgaaagacggctcaggggtcgtcgccatcaatatgaaaatcgatgagcttctgaaaacgacaaagaaagtgaacatcggaaaatcaggctacgcttttatcctgacgaaagacaaaaaagtggtcgcccacccgaaccgtgcgtcaggcacagtattaaacggggagtgggctgaacagttgttcaccagcaaaaaaggtgattttcaatacaaatacgacggccaggaaaagaaaatggcttatgatacgaacgggctgacaggctggaagattaccggaacgatgtatctggacgaaattcatgaagcggccctgccgatccttcatctgtccctgctcgttctcgtattagcgattgtcatcggaaccatcgtcatggtgctgattatccgttcaatcacaaaaccgctcaagcagcttgtgacatcatcgaaacagatcagtgaaggcgacttaacagaaacgatcgaaattcagtcaaaagatgaattaggcgagctgggcaaaagctttaacaatatggccgcttcactcaggtctctcatccatgccattcaggattccgtgaataacgtcgcatcttcctcagaagagctgacggcttcagcggagcagacaagcaaggcaacggaacatatcacactggcgatcgaacaattttctaacggaaatgaaagccaaagtgaaaatatcgaaagcgcggcggaacatatttatcaaatgaacagcgggcttaaagatatggcgaaagcatctgccgtcattaccgaatcctccgccacatcagcggaagtcgccaattcaggcggaaagctcgtccaccagacggtcggccaaatgaacgtcattgaccggtcagtgaaagaagctgaacaagtggtgcgcggacttgaaacaaaatcaaaagacattacaaacattctcggtgtcattaacggaatcgctgatcagacaaaccttcttgcgctgaacgcggcaattgaagccgcgcgtgcgggtgaatacggccggggcttctcagtcgtcgccgaagaggtcagaaaacttgcggtccagtctgccgattcagcgaaagaaatcgaaagcttaattatagaaatcgtcaacgaaatcaatacatctctcggcatgttccaatccgtcaacaaagaggtggagagcggactggatattacgaatcagaccgaaacgagcttcaaacggatttctgaaatgacgaaccagatcgccggagaaattcaaaatatgaatgcgacggtagaacagctgacagcaggatcacagcagatttcaggagcttctgagcaaatcgcgtccatcgcaaaagaaagctccgccagcattcaggatatcgcggcctctgccgaagaacagctggcttcaatggaagaaatcagttcgtcttcggaaacgttatcccaaatggcggaagaattacgtgatatgacgaaacgatttaaaatagattaatagatcatagaacacccaaatgtgctgtttgggtgttttttttagtttttttaataaatcttttgtcctatctgacgatattagatttagcttttcaaagaaggagactgaaaaaatgaaacaactgatacattggatcaaacagccatccatcagcaagccgctgatcgcggcatttttagccgtattggtgcttccggtcggcatactcgcctacttcagctaccaaacggcggggagtacattagaaagcgaactgacccacagcgcccagggaaatgtcagtgaactgaacagcgtgctggaaaacatgcttgagggtaagctgaaagcgattgactactacagcgaatcaatcacaaaggaaaaactgaacacgaaaaataaatcggtactgctcgacaatatgaagcagtatgtcaccgtaaatggcgatgtcgcgtcaatttacgccgcgtctcgcgacaaagcgtttgtgaaatatccgtccgctgacatgccgtccgattataatccgctcacgcgcgagtggtatacaaaggcggttgaaaaaagcggacagccggtgtttaccgagccttataaagacgctgcaaccggacagacggtcgttacgattgcccagcagacaaaagacggatcaggcgttgtggcgcttgatattaatctgggcgacctgctgaacgcttccgaacgcgtccagatcggtcataaaggatttgccttcattacaacgggggataaaaaatacatcgcccatccgactataaaagcgggaacggaaggctccggagagtggacgaaagaagtattttccaaatcaagcggatcgtttgaatacatgtttgaaggacagcagaagaaaatggctttcacgacaaacaaactgacgggctggaaaatcgccggcacattttttgtcagtgagatccatgacgcagcctcgcctgtcatgaaaatggcgctgatcatcctggcggtttctcttatcgtcggcggtattttaatcttctttatcattcgctcgattgcaaaaccgctcaaaaaacttgtctcgacatcagataaaatcagtgacggcgatttaacggaagtcattgacatcaagtcaaaaaatgaattcgggcagctcagccaaagcttcaatgagatgtcggcatcactccggtctgtcatcggcgtcatccaatcatccgtcgaacatgtcgcttcttcatccgaagagctgacggcatccgccggacagacaagcaaggcgacagagcatattactctggcgattgaacaattctcaaacggaaacgaatcacaaagcgagaaattggaagaaagtgctgatcacctttcccaaatgaatgcgggcattgccgagacggcgaatgtatcggcggaaatcactgaatccgccatccaaacctctgaaacggccggaagcggagaagaattagtggcgaaaacggtcggccagatgaaaacaattgatcgttccgtacagcaggcggaagccgtcgtaaaagggctggaaacgaagtcgcacgacattaagagcattctgaacgttattaacggcattgccgatcaaacaaatctgcttgccttaaacgcggccattgaagcggcaagagcaggcgaatacgggcggggcttctccgtcgttgcggaagaagtgaggaagcttgccgtacaatcagccggctccgcaaaggaaatcgaaacgctgattcaggaaatcgtcaaagaaatcgccacatcgctttccgtattccaagcggtgaatcaagatgtgaaggaaggcctcgatattacggatcaaacggccgaaagcttcaaaaaaatctcagagatgacgactcagatttcaggcgccttgcagcatatgaacggaacgcttgagcagcttgcagccgggtcgcaaaatgtgacaaacgcggtggaggacattacctcagtcgccaaagaagggtccgccggcattcaagacatcgccgcctcagctgaagagcagctggcctccatggaagaaatcagttcatccgccgaaacgcttgcgcatatggctgaagaactgcaacaggtcacacggaaatttacgattcagtctgaagacgaagaacagctgtaacgagctgtttcttttcctcatctgaaaaaagcgatacactaatataaaagaagggagtggcagtgatgagattagaaggcaaaaaagttatagcgcttgtcagtgacgattttgaagacttagagctttggtatcccgtctatcggctgagagaggaaggcgcgatcgttcatttaataggagaagaagcgggccgttcatacaaaggaaaatacggcgtgcccgcgacggcggattacgattttaagagcctgattattcaggagtatgatgccgtgctcgtgcctggcggctgggctcctgacaaactgcgaagatatcccgaagttttggacatcatccgtacgatgaacgagcagaaaaagccgatcggccagatctgccatgcgggctgggtgcttatatctgccggaattctcgcaggaaaaaaagtaacgagcacgcccggcatcaaagacgacatgacaaatgcaggggcaaagtggctggatgaagctgtcgtaactgacggccacattgtatcaagccgccgcccgcccgaccttccgcagtatgcaaaagcgtttgctgacctgttagcgtccaaataaaaaacatccgcccgaatccgggcggatgtttttagttttgatcggcgggaaagacgattccgatttgttttctcgcttcttccataatgtttgccgtaatgaaagaacgttcaaatgtattttcggaagactcccgctgtccgtttcgaagaagattgatgaattcagccgtttcgtagtacatcgaaggtttcagatcagggactgaaatgtcttccgtccggccgtcacgatagcggatttccgcccgttccggtccgtgaatgctgtccagaacgatcgtgccttcttcaccctgaatttccgccggggcaaacgaatttgagattttcgaatgcatcagcaccgcttcaaatccgtcgtatgacagaatgaccgtgccttcgccgtcaacgccggatgctagtttatgaccggtcgcaatgacgtttttcggtttgccgaacaggacgacggccggataaatgcagtacacgccgatgtccattaacgaaccgttcgataattcaggcttaaacgcgttaagcaccgtaccgtttttatatgcatcatatcgtgatgaatattggcagtagcttgccgtgaatctcctgacgggtccgattttatgtaagtggttttgaagcatgctgaagttcggcaggaacgtcgttttcatggcttccatcaagagaacgccgttcgttttggctgcgtgaatcatttcatccgtttcccttgcgttagacgcaaacggtttttcgcatagtacatgcttgccgtgttccataaaaaggaccgcctgctctttgtgaaatgcattcgggctggcgagatacaccgcgtcataggctttgctttccgccatttctttcaggctggtgaaataatgagcagcgccgtgtttgccggcgaattccgccgcacgttcctcagttctggaataaaccgccgttaattgaaaatcatcaatagcagaagccgcctccagaaatcgttctgtaatccaattcgttccgactgttgcaaatcgaatcattgctatcgctccttctatgtattggcttacattatagctttttttcaaagaaacataaatggaaaaaaggctgccagctaaacggataggaaaaattcccatagagaccggttattatttttcattacaggaacgatagtgtacaatttaagtaaaatacatatgatggaggaacaatagtggaaacattgcaaacatggggcggcagatttaaacagtttttcttagacaataaatttgtcttgtttttgcttgtattgctgctcatcggtctcaatatccttgtctttatgaagacatcatttattttcacacccattatcgtcctgctcaaaacgattgcgctccccgtcattttgacaggaattgtttattatctgcttaatccgatcgtagatatattggaaaaaataagagtgaaaagagtctattccatcctgctcctttacctcattattatagggctgatttcgattacggtcgtttcaattattccgtttttaaaggaacagatcatgagcctgatcgacaacctgccgaaatatgtggacatcgttgaagatcagacgaaaagcctgatcggaagcgattttgtaaatcaggcgcaaaagacgatgaatatcaacatttcggatcttgccaataaagtatcggcgcaggcggcgacaattgcaaacagcacatttaccggagtcgggaattttatcggcgcgctgactgaagtgattatttcaattgtgaccgtgccgtttattctgttctatttgctgaaagacggcaaaaaactgccgatctatatcttaaagtttgtgcccacccgtctgaaagaacaaacgtatacgatgctgagtgaaatgaaccacagattaagctcctatatcagaggacaggtcatcgtcagcttctgcatcgggtttttattatttatcggctatctgattatcggacttgattatgcgtcactgcttgcggtcattgccgcttgtacgagcgttgttccgtatttagggccgaccattgctatcacgccggcgattattatcgcgttggtcacttcgccctttatgctgctgaagcttgcgattgtctggaccgttgtccagctcgtggaagggaaattaatttcgccgcagatcatggggaaaaatcttcacattcacccgattaccatcatctttgttcttttaaccgccggaaagctgttcggggttgtcggcattattttagccatcccggggtatgcggtcatcaaagtggtcacgacccatctgtttgattggttcaaaatgcgttcgcatttatatgaagaagaaaaaaatgatgctgtatcgaagtcataaaatcggaacggacatgatatttattataagacaggctttccttcaaaggagagcttctcttttgtaaatgatgaatgaagggaagaatgggatgacactatgggagatgttcacagcagccgttttgggaatcgtggaagggctgacggagtacgcgccggtttcttccacgggacatatgatcatagcggatgacatctggctgaaatccggaagcctgatgaatccggaagccgccaattccttcaaagtggtgattcagctcggttcgattctggcggtggccattgtgtttaaggatcggatattacatttactcggcctcaaaaaaaacgtcacgcgcgatcagcagaagggatacaggctgaccatcgcgcaaatcgccgtcggtcttgttccagcggcggtgctcggctttttatttgaggatttcattgaccgctatttattctccgtcagaacggtcgcttacggattaattgccggagccgtgcttatgcttatagcggactggatcaataaaaggaaagaaacgatcgatacggtggacagaatcacctacaaacaggctttctgtgtcggattattccagtgtctcgccttatggcccggattttcccgatcaggctcaacgattgccggaggtgttattgtgggcttgaatcaccgggcagccgcagacttcacatttattatggcgattccgattatggcgggcgcaagccttctgaagctggtgaaatactggagcagtctttcttatgacatgattccgttttttcttgtcggctttatctgcgcctttgtcgtcgccctcttagtcgtcaagttttttcttcggctcattaaccggattaagcttgtcccgttcgccatttaccgtgtcatcctcggcatcattttaatcatgctcgtgcgataaacgaagaggccccccggagggtcttctttttatgttcgaaaaacgtctcaggaaaatatgagcaaactgaattttctgcttgaaattcatagaagagtcgtctataataaaacatgacgttacagcacggggccatagctcagctgggagagcgctacgctggcagcgtagaggtcaggggttcgagcccccttggctccatacctttaaacccttattctataaataagggtttttttgttttttcatcctctgcagcagcctctgtgttccgcttcatttctaacaactcaaaataaaggaaagagagaaaatgaaaaagaaaatctatcttatattatctctgtcagctgcactggcacttcttttaacggcgctcccggctctttctcctgtcatcttcacgtctgcttcagaaaaaggagccatcaggcatgacatttataaaaaaggatatccgtatcaaagctactttgcgattcttcaaaaagaagaaggaggcggagaggacgggaacctttattatgtaaattggttcaattggaaagatgaaaccggacagacgccgcacgtatgttattcaaaaaaatcgtccgaaggcgagtacaaagtaagctgcggaaccggatcgtaatgatcaagagcccctctgcaatgaggggctctttctgtcgatgtggatccgcttaataccccctatagaacggctgaacataatgccgatacggatcattcggataatgcgtatttggctgataaggcttattcatatcatgaatacccgtgttttcagactgtccgcagtatttatcgggacctatcacagttgattgccggatcggtgaaacggctttttcccactcgtgctcattcagacagtacgtatgcgccatgatctcaggcggcgtcagacggagaatatccgagccatatatcacttcaggcgaaggggcgtcaaatatggccaaaaggtgggttttgtctgaagtggcgacttcataatgccaccacccctgcggaacattcgccacttgtcctggagagatcggataattccgtattttctgggtgaacggattcagcatcgacaccaccgcggaacccgaaatacagtacaccaattcagcggcgttttgatgggtatgcggttcaatcacatttgttttactcagaaagatatctaataatgaaatattttcaagcgtgtttaactgtttaatccccaatacattgataaagttccgagcatctttcgtaaaaaaacggctctcatttacatcataagtgaactgtgtattcggagacgtgtaatcgatatcggaaaccatgcaatcccccgctttcatctttaaacgtatattcccaaatatatgtgtccctgtttcaccgggtgataaaaaaggaggtaaaatccataaattccaaattcaacacaatattgtgacgacttttttaaagattcattttagatatatcttttattcgaaatatctcttactataaagatatattaaaaatacatctttagaagggttgaggatgaacatgctggatgagagaacagtagacatcatcaaaagcacagtacccgtattaaaaacacatggagaaaacatcaccggacgcttttataacctgatgtttcaagatcatcccgaactgttaaatatgtttaaccaaacgaaccaaaagaaacagactcagcgcgcagcattggcaaatgcagttattgcggctgcggcgaatattgatcaattagaacaaatcattccggcggtcagacagatcggccataaacacacaagtatcggtgtaaaaccggaacattatccgattgtcggaaagtatctgcttctggcgattaaggatgtgctgcaggatgccgcaactcctgaaattatgcaggcatgggaaaaagcttacggtgttattgcggaggcttttatcggcattgaaaaagacatgtacagtgaagccggatggcaggggtataaagaatttacggttatacagaaaacaaaagaaagcaaagatatcacatcattttatatcaaaccgagtgacggctcttcgcttcctggatttgaagcgggacaatatatcagcattaaagtgaggattgcggattctccttatacgcacattcgccagtacagcctgtctgatgcttctcgaaaaggcgcatatcggatatctgtgaaaaaggacggagcggtttcttctcatctccacaatgaagttcaagagggagataaacttgaagtcagtgcacccgccggggatttcaagctgtcttcttccgaaaaaccggttgttcttatcagtgccggttccggaatcacgccgatgatgagcatgctgaaaacagccgccgaaaaacagcccgagcgttccgttacttttattcatgccgcgaaaaacggagagtacgccgcgttccgcaaagaggctgaacaagctgcggagaatcatccgaatattaacgtcatttatgtatacagtgaaccggcagaacaagaccgctcaggagacaagcctttttacagcggccggattgatcaaaccttcttggagcagcttcatctgaatcaagatgctgaatgttacttgtgcggatcagcacagtttatgacgcaaatgaaagatatgattcttgcactcgggtttgactctgattccgttcaatttgaattgttcggccctcagctgagcatggcataacaaaaaaagactcctcattgaggagtcttttttatttgcacgatgtgttctttctccgtctttttccctattttattgaaattttcatcaatgaccagtaaaattataaatctagtgattccggaattaaaggaaggttgatatgaaaaagaaagcaaagaccaaaagggtgcttgggtgcctttttgctgtatctcttatattcggattatttctggtatcaatggtattttcgaaattcatagtgacggaagaaaaaccgcctgaagaggtggacgagcagcaggtctttattgacagcctttccgggcatgctcaaattttatatgagaaatatcatgtccttccgagcatcaccctcgcacaggccattctcgaatcggactgggggaacagtgagcttgcggggaaagcgcgcaacctgttcggtgtaaaaggtgattataaaggaaaacacgtcacgatgaaaacggatgaatttgaaaaaggaaaacgaaaaacgattcgggcaaaattccgtaaatacagcacgttttttgaatcaatggatgaccatgccaaattatttgtcaacggaacgtcttggaataaaaagaagtacaagcccgtcattgaagcggacaattataaaacagcggcggctgcccttcaaaaatccggctacgccacagaccccggctatgctgaaaaaattaaagatgtcatagaaacctataacctgaatgaatatgacaaaatcaatgcctctcttaaagcagttgataagaaaggcgccatcaaagaccacgccattgaagacgtgtggtccaagccgtcgaaagagcggcattctattaaactggcatcggcgcaaaagtttaccggccagcatattaaagtcgtatctgaaaaacaaaacggagaatccgtctggtaccaaattcaagtgaaagataagctggtcggctgggttgaccaaaccgccgtccagttaagtgaagaaacataagcatcaaaaaaagccggcagcttgccggctttttttacattccttcagtttcaaaccttttaatatcacgtttatgccccatcagcacaaggcagtcacattcatgaatgacagtctccggagaaggggacagctgaatgtctccattatgtttcacggcgagaatggtgcagccgaatctggcgcgtgcgccgagatcaagaagggattttaaatgcagctttttagtggctgaaagctccacaatgctgtattcatctgacaaatcgatgtaatttaagacgttttcatctgaaaggctttgcgcaatccgcacgcccatatccttttcaggatggataatacgatcagcaccgatcttttcaagcactttgtgatgataatagttttgcgctttcacccaaatattagggatgttcagctccttcaataacagcgtcgtcagcgtgcttgcctgtatattggctccgattgctacgatgacatattcaaaatttctgatgccgagcgactgaagctcgctttcttccgttgaatttgcccgcacggcatgcgtggcataagaggagtatgcgttgacccgctcttcgctgatatcgatcgcaagcacctcatgccccattttaaaaagctctttacagatgcttccgccgaaacggccgagtccgatgacggcaaattgtttatttttgatttttcccaatcctcataactccttaagaaactgttttcgtcactccaaatacaacaaacaagaatgtactcctgtttcaggggtttgtcaatgcgagggccggaagaaagaaaacagcacaaaaaaagaccggctgacaagcgatgagcttgtgccggtccgtttttcgcaattatttgcagttgcatggctgtgtcggcggtgtgctgcgtttttgaacaacaattgtgtcctcagcatagaatttagagccgatgcttaatgatttattttctgcacggaacttatatgtacctgcagcaggcaatgttttattattaagagaaagcttaaattccgctgcgccgagcaaatcaatgtttaacggaagtctgactgttttgccgttattcagaatctgtctttcgcgcaaagcgtgtccgttgactgtatcttttgttgtagccgcaaatccgctaggaagggtaaattccataacgcctaagctcaggatcgtgttcggacggtacgtcaattcgatatcagaaaatgaccattcctgctggctggcacctgtatattttgcaaataaggtagcagtcgctttcgtggacatttccggctcgtgaacggttgagcctgactcagcggcgaatgacgctgtcggcagagaaagaagcaaaaccaggccgaataaacttgccatgacagttgagaaaaacttgtgtttcatttttataaatccccctaaaaaaaatttgctgattgttcttaaaaaagaacgaccatacctataaaaatttaccatcaattttaatggaagtaaatggggttatgttcctatattttctcaaaaataatcaaatcacgacaaaaaacgcctgaatcaaaatcaggcgtttttttcgtccgtttctatcggaataaatttaaaaatctccccgctctgaaccgagtcggcgagccgcttcagccaatgataataagctttcgagctttcaagctgatcatataactgccgcgcttcttcctgtaattccgcgctgccttcctcggccagcaaaacggactgcaaatccgcctgagcctgtacgatggcggacaaattcacctgaacttcacggtcccatttcggcggaaagaaattcgtgaaaaacgtaaagaaatccttttccgctacaaacgtatgcttccgtgtgccgcggtgaaaggtttttttgaccacatttaaatcctgcagctttttaacgcccgtgctcatactcggtttgctcatctgcagttcctcacgcatttcgtcaagcgtcatttcatccctcatatacattgttccgtataaaatcccgacactccgggtgattccgtaaagatccatcgtctctgcaatggaatcaatgacaagatccctggcttgttctatagctgcgaattctggattctcatccatactgtccctcttttcctcttgaagtttaaatttgttaagtcatttctttatgttcttaatcttaacgaatcatgacaaaatgtcaaaatctaaacggactgaccgggttttgacaggcaaaaaaacatgtgttaaattaacattgttaaaaacattaaatttttatttaacaaacttacttctcggtaaggaggactcttatgagcaaaacgctttatatcggcggcgaatggatcagtgcagaaaaaaaacagacccgccgtatcattaatccatttaatcaagaagaaattgcaacggtatgcgaaggagaccgggatgatgcggtgaaagccatcgccgcagccagaaaagcatttgatgaaggggaatggccggtgctttccgggctcgagcgcggacaatttgttctgaaaattgcggaattaatcagacgcgatctgaacgaattagctgagctggaatcgcttgatacaggaaaaacgattgaagaaagtaaagccgatatggatgatatcgcaaatgtatttcaatattatgccggtttggcggataaagacggaggcgaagtcatttcatctccgattcccgattcagtaagtaaaatcgtcagagagccaattggcgtatgcggacaaattacgccgtggaactatccgctccttcaggcgagctggaaaatcgctcccgctcttgcggctggaaacacgatcgttttaaagccgagcgagattactccgcttacaaccattaaagtctttcaattaatagaagaagccggtattccgaaaggggccgccaatctcgtgctggggccgggcgcctctgtcggcgatgagctggcgagaaacctcgacgtcgatttggtctcttttacgggcggaattgaaacaggcaaaaaaatcatgcaggcggcaagcggcaacgtgaaaaagattgccctggagcttggcggcaaaaatccgaatatcgtatttcaagatgcagatctcgaaacagctgcagatcaagcgctgaacgccgtgtttttccatgccggtcaagtttgttcggccgggtcacgtcttttggtggacgaagccattcatgatgaatttttagccgagctgatcaagcgcacgaaacgcatcaaattaggaaacggttttcatgaagatacggaaagcggtccgctgatttccgccgagcatcgggccaaagtcgaaaaatacgtagaaatcggtatcgaagaaggggcaaaactggaaacaggcggcaaacgtcctgatgatcccgcccttcaaaacggtttcttctatgaacctactattttctcaaactgcaagtctgatatgcgaatagtccaagaggaaatcttcggccccgttttaacagtcgagtcattctcttcagaagaagaagtgatcagacttgccaacgataccatttacgggctggccggagcggtatggtcaaaggatattgaaaaatgcgaacgcgtagccgccaaactgcggatgggaacggtatggatcaatgatttccacccgtatttcgcgcaagcgccatggggcgggtacaaacaatcgggcttcggccgtgaactcggcaaaatcggcctggaagaatacacggaaatcaaacatatttaccgcaatacgaaacctgcggctgtgaactggtttcaagcataattaggaggagatacaatatgacattaaatatgaaagtagaaagcatgcataaattccatacattcgaaatcccgacagtcattaaacacggaatcggcgcgattcagcacgcgggaagtgaagtcagagcgcttggcgtcacaaaagcgctgctcgtaacagacccgggaatttataacgcgggagtggcaaacccggtcattgaatctttgcaggaagcgggcatcgaagtcgtcctgtttaacaaagtggagccgaacccgcctgtacgtcttgtaaacgaaggatcagaactgtataaaaaagaaaactgcaacggtcttgtggctgtcggcggcggaagctccatggatacggcgaaagcgatcggggtagaagcgacacacgaaggaagcgtgcttgattatgaagccgcggaaggcaaaaagccgctggaaaaccgcattcctccgctgacaacgatcccgacgactgcgggaacaggttcagaggtcacacaatgggcggtcattacagatgaggaaagagaatttaaattcaatacgggcggaccgcttatcgctgcgcatttaacggtcattgaccctgagctgcacacgtccatgcctccgcatgtgacggccatgacaggtattgacgcacttgcgcacgccatcgagtgctatacgatgaaattcgcgcagccgatcactgatgccgtcgctttaatggccattgaatatgcggcgcattatattaagcgcgcgtttgcggacggagaggatttggaagcaagatacggcatggcgcaggcggcgatgcttgccggcctttcatacggcagtgaatcagcaggcgcggcgcatgcgatgagccagacgctcggcggcatcatccctgtcgctcacggacaatgcgtcgcagctatgatgggaccggtaatggaatacaactggaaaggctatccggaaaaattcgcccgcatcgccaaagcattcggaatcgatacaagcaacatgacaaccgaagaagcggccaaagcgtccgtcaactggatgtatgatcttgtaaaagatttagaagtgccgagtttagaagaacaaggtgtgtctccggacatgattgaacgtttatcaaaagaagccatgaaagatccgcagactttcggaaatccaagagatttgaatgagaaagcatacaactggatttacaaacgctgctttgacttaacgccgaaaacggtataataaatgaaccccgctcctttacagagcggggttttttaaggataatgtcaagaaaaaggcggtggtggctgatgtggaaacgcataacagcaaagacggaaggcgtatatatagcggataccgaacaatttgttaccaaaaagatggacaagcttcgcgcggaatacggcgggtttcccggtgacctgcatttcggactgacaaaaaaggccggcgcgcgtgagccgatgtatgaaagaggaacagaaatttttaaccggagacaaatttcaatcgtgtccatggaggaatgtgatgacattgcggagaagatggggatttctcatatctttcccgaatggctcggcgctaacatcgcaatcagcggtttttctgcgctgacgccgcttaaagaaggaagcagaatgatttttccaagcggtgcgtctctgttgtgcgagggagaaaatgatccgtgcattcagccgggagaagtcattcaatccttttatccggctcagccaaaactcgccgcggcgtttgtgaggcacgcgatgggcagaagaggaattgtctgtattgttgaacgcccgggtgatatatgcacgggcgatgcggtcaccatccattcctatgaaccgaaacgcgccaagaaaaaaatcgagaaggtctgactcagaccttctcgattttttgtttgatttcttctatttgatcgatgtgacgcttttcatgatggccgataaaatcaatccactgccggatcgtcagttcttgaaaaacgggatgcggaagcacacgttcaaaatcttcctcgtttaatgatgaaataactgcggtcagctgctgtcttgccgtatctaattcttgttttgcttcaatgactgagattcggttttgctcaggttcgaggtgtgacggcgccggccgtttatttgatctgtcctctataaactccatcggtttgtcttcgatttttttaaacggtgcgtcttttgcctgctttgataaaagggtctgcgctgtttcgtcaattttctttaaatggtcaaggacttcccgcacgctccactcatcagccgcgggctttcggttgaattcctcatcagagagccctttcagtacttcccaggtctgctgtctggcttcattaaaaatgctcatcctatctcctcctttagagtaaacatatcatatccggattggataatcatgtaatcagccttccttatcagaaaattgaaaccatttacctttacatccgtatataaagtaacactccgacacctcagccgaaaggaggatagaatgtggacatatttcatctgccgtttgaaacggtctatctttacacattgattatttcgggaagtctcacgcttttgattctgttttttcaagatgtgtttcacggcctctcagaagccattcctgtttcatttttaaaccctgcattgattctgtcttttttaacaatcttttcagcctcaggttatatcggcgaaatcgccgctccgctatcaagtcctgtcattgcgttgctttcatttgttctttcggttcttttggtcagcctgcttcacttcttcgtccttgccccgctttcatcagcggaagaatcgctcgcatatcgggagacagatttaaagggcagggtcggcagggtcattacttccgtcccgaaagacggctatggggaagtgatcatagagggaatagggggcgccatttctaaatcagccgtcagctttgatcaagaacagatcagatacggaacggccgtattagtgattgacgtgaaagacggagtgctttttgtgacgccgcatgaaccaatctgatatctaagggggaactgttatgactatgccgattatcattgttatcggaatcgtattctttttactcatcgcacttattgctgtatttattacgaagtaccggacagcggggccggacgaagcccttatcgtgaccggaagttatttgggaaataagaacgtccacattgatgaaggcggaaatcgtctgaaaatcgtccggggcgggggaacgttcgtgctcccggtattccagcaggcagaacctctcagtttactgtcaagcaaacttgatgtctctacacctgaagtctatacagagcaaggggtgccggtaatggccgacggaaccgccattattaaaatcggaggctccatcggtgaaatcgccacagcagctgaacaatttttggggaaatccaaggacgaccgtgagcaggaggcgcgggaggtgctggaaggccatctgcgctccatcctcggctccatgaccgttgaagagatttataaaaacagggaaaagttttctcaggaagtccagcgggtcgcgtctcaggatcttgctaaaatggggctgatgatcgtttcttttacgattaaagacgtccgggataaaaacggctatcttgaatcattaggcaagccgagaatcgcccaagtcaagcgggatgcggacattgccacggcagaagcggataaagagacgaggattaaacgcgcggccgctgataaagacgcaaaaaaatcagagctggagcgggcgacggaaatagctgaagcggaaaaaatcaatcagctgaaaatggcggaatacagaagagagcaggatacagcaaaagccaatgccgaccaggcatatgatcttgaaaccgcaaaagcgcgccagcaggtgacagagcaggaaatgcaaattaaaattattgagcggcaaaagcagattgaattggaggaaaaagaaattctgcgccgtgagcgccaatatgactctgaagtgaagaaaaaagccgatgctgaccgttactcggtggaacaagcggccgcggccgcaaaagcgaagcagctcgccgaagccgatgccgagcagtacagcatcgaagcgatggccaaggcggaagcggaacgcgtgagaattgacggtcttgctaaagcggaggctgaaaaggcgagaggagaaaccgaagcggaagtcatccgcctgaaaggtctcgcagaagcggaagctaaagaaaaaatcgccgacgcattcgaaaaatacgggcaggctgcaatccttgatatgattgtgaaaatgctgcctgaatacgcaaaacaagtctcagcgcctctttcaaacattgataaaattaccgtcgtggatacgggaggaagcggtgaaaacggcggggccaataaagtcacaggctacgcaaccaatttaatggccggtctccaggaaagcttaaaagcatcttccggaatcaatgtaaaagagctgattgagaatttttcaggcaaaggaaacataaaacaaagcataaatgaacttacaaaagaactgagtgattctaacgaacggcacagcccggaataaaaaaacagcaggcgtaaaccgcctgctgtttcagttcgtccgcttagcttcaagaagccgcggcgcagtcatgaataataagataaggacaatggccgaaaggataaaagaaggaatcatgtaagtcgcgttatagacggatgaataaatccagaccggcgtacccttcggagcatagcttccgaaaaagactgctccggagaccacatgcgccgcataccgcagcacactgccggtgaaaacaccgcctataacatacatcgttaaagcgcctctttttttattcaatgccgatgctcgtacaccggaagcgagcaagccgctgaaaccgagaactgcaaatgccgcgatataatcaagaaatagctgcaccgggtgctgcaaaaacaaattgccgatggcgatctggacaatccctgttaaaaagcctgtcgtaagcccggccttcactccccagcggaatgaaatcaaaaaaatcggaatcatcataatagagaccgaacccccttggggcatccggagaaacatgcctgagacaatgtccagaatgacagccgccccggtcataatcgctatttcaattaagcgcacaagctgtgttgaatgattcatagttttccccctggtcagacaaccgtatcaaggataaacaaaaaagcagcgcggggaaggatgggaaaaggtccgcgcgctgcttacataaactgcaaatcatttggctttgccacatccctacgccagcgttaactaacaggttcaaagggtcagaacaaaacgttcactctcagctttaatgctccccttgtggtcatcaagtatttagttcaatcttactatacaagaaaatataccaaaccacaagacagcttatctttctatagaagagaaactgaaataagtatgaaagaaaataattaatgattttttttaaaaaactattgtcatattttcaaaagggtgttatattattaaacgtcgctgatgaacagcagacaacaacgaaaagcttcggaaacaacttaaaaaaagttattgacataaaagaagctgggtggtaagataataaagctgcttcaataagcggtcatgatctttgaaaactaaacaagacaaaacgtacctgttaattcaaagttttaaataaatcgcacagtgatgtgcgtagtcagtcaaactaaggtctgcacgatgcagatcacacagacgttactgcaggatgcagtgaacttagtctgtgttccatttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttctaaggattttaacggaatataagaccttgggtcttataaacagaacgttccctgtcttgtttagttttgaaggatcattccttcaaaacataggaacacctgctaaatgcgccacttcctgtggcaacgcatgtgttagcatgtcctatgcgttgttctttgaaaactagataacagaagtaattcacattcaattagtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaatacataggatatgagaaggcagacccggggaactgaaacatctaagtacccggaggaagagaaagcaaatgcgattccctgagtagcggcgagcgaaacgggaccagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgaattgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtctcggaggtagagcactgattggactaggggcccctaccgggttaccgaattcagtcaaactccgaatgccgatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagcaagaccggaaggacttgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggataacaggttgatattcctgtaccacctcctcaccatttgagcaatggggggacgcaggaggatagggtaagcgcggtattggatatccgcgtccaagcagttaggctgggaaataggcaaatccgtttcccgtgaaggctgagctgtgatggcgagcgaattatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccaatttgaatgtatgcttactgttatctagttttgagagaacactctcaatggtttggtggcgatagcgaagaggtcacacccgttcccatgccgaacacggaagttaagctcttcagcgccgatggtagtcgggggtttccccctgtgagagtaggacgccgccaagccattacacgtaagtgtaatatacggaggattagctcagctgggagagcatctgccttacaagcagagggtcggcggttcgagcccgtcatcctccaccattccaatcatacataagttggcgtattaggccggtgtagctcaattggtagagcaactgacttgtaatcagtaggttgggggttcaagtcctcttgccggcaccacttttatatgttatactatataagtctcttgtaataagagccattagctcagttggtagagcatctgacttttaatcagagggtcgaaggttcgagtccttcatggctcaccatgtttttcttgcggatgtggcggaattggcagacgcgctagaatcaggctctagtgtctttacagacgtgggggttcaagtcccttcatccgcattgccaaacgcggaagtagttcagtggtagaacatcaccttgccaaggtgggggtcgcgggttcgaatcccgtcttccgctccaactatactataccatccatgccggggtggtggaattggcagacacacaggacttaaaatcctgcggtaggtgactaccgtgccggttcaagtccggccctcggcacttattgttgcgcccgtagctcaattggatagagcgtttgactacggatcaaaaggttaggggttcgactcctctcgggcgcgccatacatacttttgaaaaacgggaagtagctcagcttggtagagcacatggtttgggaccatggggtcgcaggttcgaatcctgtcttcccgaccactttggggccttagctcagctgggagagcgcctgctttgcacgcaggaggtcagcggttcgatcccgctaggctccacttgattttaattgtttttggcggtgtagctcagctggctagagcgtacggttcatacccgtgaggtcgggggttcgatcccctccgccgctaccattggacctttagctcagttggttagagcagacggctcataaccgtccggtcgtaggttcgagtcctacaaggtccaccacttatacggaggaatacccaagtctggctgaagggatcggtcttgaaaaccgacaggggtgtcaaagcccgcgggggttcgaatccctcttcctccgccatatctaatttaattatcatcgcggggtggagcagttcggtagctcgtcgggctcataacccgaaggtcgcaggttcaaatcctgcccccgcaaccaaaaaatggtccggtagttcagttggttagaatgcctgcctgtcacgcaggaggtcgcgggttcgagtcccgtccggaccgccatttataaaaaggctcggtagctcagttggtagagcaacggactgaaaatccgtgtgtcggcggttcgattccgtcccgagccaccatttaatttaatattgttttggcggttgtggcgaagtggttaacgcaccagattgtggctctggcactcgtgggttcgattcccatcaatcgccccaaacaacatgcgggtgtagtttagtggtaaaacctcagccttccaagctgatgtcgtgggttcgattcccatcacccgctccatttttatattgtcatgggcctgtagctcagctggttagagcgcacgcctgataagcgtgaggtcggtggttcgagtccactcaggcccaccatgatgatttttccacagtagctcagtggtagagctatcggctgttaaccgatcggtcgcaggttcgaatcctgcctgtggagccatacggagaagtactcaagtggctgaagaggcgcccctgctaagggtgtaggtcgtgtaagcggcgcgagggttcaaatccctccttctccgccataaggcccgttggtcaagcggttaagacaccgccctttcacggcggtaacacgggttcgaatcccgtacgggtcattaaaaaaaccttgcatagtatgcaaggttttttattatgcgttcatagcgtaaatggtaaaagacaggtatgtggcaaaagcgctccataataaataaggaaccagaagccaggctgaagctttactgtatttaccggcaatgagcaacagaatgagtgttgtcacagccacaagcaggcaatcgatagatgcagcaagcaaatttttctgtgtgaattgaaaatagctgaatccttgattcacgatataattgatgagaagcatcacccaaaaagctttggattctttacatgaaaactttgcatatattaaggctgctgagagcgaaataagcgcaaacaaaaccgcccatatgatgccgatcactgatccgcccagcgtccagtcaggtttttgcagcgcgtcgtaccattcccggtcgatgggaaagagaaaccctgctaaagaaaacaagacatatgtaatgataaatacaataatcgcaccgatatacttctttttcatttgttccctccgtcattcaatgtcaatacgttagttccctttcttggaaagattaaaccgttcaaaaggttcatgcaccattaagtgtatgagttttcggtgtgaaaatgcagcaaaccaattatttgtattcaaaaaccccggcctgccggggttttaatcagcatgaaggtcgccaaaggtcgtcataattccttcttcgtccagttcctgctcatatttttcgtgtgccttgcttggatacacggaaatgttttttccggtaatatctgtcgcgataaagttttcataatcctcagcatagccgatgttttcttctgagttcattgtcatatccccatagctgagcggcggatcttctaaatcctgaggcgtttctgagtttccgtatccctcaacatcctgataagcatcttcactatcgtaagccgcccggattgattcatcatcatcaaattcaaactgtccgaacggtgtttcctcttcaatcggcctgtctttggaaacggcatcctgcgaggaatattccgccaatgtcgtagccgtcggcagagcttcaagtctgtcataaggaatgtccttgccgctgacttcacatgtgccgtatgtgccgttttcaatttgtttcagagagtaatcaatatcgcgaaggtgctccctttcatggtcgagcagagccaggtctttttcccgctcgtataattcggtcgcctgatcgccgggatgattgtcataggaagacaattcgccggatgattgatacgggaattcatcagttaactgaaattgatcattttctttaaagcggcttaaaatatcatctctggcttcttccaattctttttttaagtgtgtgatctgttcgtttgtaagcacatcaatccctcgtttctatgtgatgcttactgttagtatgaacgtttttacgcagaaaaatggtggataaaaatagtcattttcccacgaggaagtaaaaggatacagtgattgccgagagtggggaaagaaaattcaagtttgtttctttattcatttgcgcaaaaaggtttataataagaaatgcaggcattttgtcgtgctcaaatctgtgtgtttgacacaaattcatcacaggtgtattgtattaaaagcatttaacggattatggaggaatgtctcatggtgacaacggtgcagcatacgttccgagaggaagcagatcatgcattacataaagccaaacaagtcaaccatgctgtcttattgagctattcaagacgtattgcgtctttagaccctctatcatttttcaaagacggagcaaaaaaatataaaggcaaacgatttttttggtcagaacccggtagtgaattaacaatagtcggtcttggcacagaagcgctgttccaatcgaatgaaaaaaatggaaaacgttatcacgacgtttttgaacaatgggagcgctttaaaaagacggcttttcatattcatgaagaagaagaggcggcgcataccgcggtcggccctgtcttattcggcggtttttcatttaatcccgctgaagagagaggagacgaatggaacgggtttgaagaaggaatgttctttatcccctcactcatgctgacaaagacggcagacggcgattatttaaccgtcaatcaatgggcggcagacggtaatcaggcagaagatacgctgaaacgtctgaaatctttttcagaagcttttgcagtttcttcaattgagtatgaagaatatcctgttttaacaaaagcggaagaacttgatgtggaaaactggcttgaagccattaaaacagcaacaaatgatatgaaggcaaatcaatatgataaagtcgtgctggcaagggaagtcgttttgtcatatgatgggcctattccggcggagagcgttgtccgcaagcttttgacggaccaaacgacaagctatgtttttgcgattgagcagggagataaatgctttgtcggcgcttcaccggaacggctgatcaaaaaatcaggcaaagacgttatgtccacctgtctggcaggttcaattaagcgcggagaaaatcaacaagaagatgaccgtctcggcaaagagctgctgcatgacgaaaaaaatctcgcggaacatgattttgtggttaagatgatacacgattctttcttgtcgagctgcagtgatgtgaaaaagcctgcaggcccgcaattatataaaacaaaaagtgttcagcatctatatacgccgatcacaggcaatctgaaaacgtccgcttcgctgtttgatttaattgaaaagctgcatcccactccggcattgggaggagctcctcagcagaaagctgttgaagttatcgctgatattgaaccgatgacacgcggatggtatgcggctccgatcggctggatggacggcagggaaaacggagaatttgtcgtggctatccgatcagggctgattgaaggcaaaagtgcgcggcttttcgcaggctgcggcattgttgaagattcagatccgcaatcagaatatgaagaaacacaaattaaactaaagccgatgatctctgctttaggaggtgaaaggctttgacaaacccgattacacattatatcggaagctttattgatgaattcgcgctatcgggtgtcaccgacgcggttgtttgcccgggatcgaggtcaactcccctggcggttttggcggcggcccacccggatattcaagtccatatacagattgatgaacgatccgcaggttttttcgcactcggtcttgcaaaagcccgccagcgtccggtcatgctgatttgtacgtcaggaacggcagcggctaacttctatccggccgtgattgaagctcattattcaagagtgcctcttattgtcctgactgctgaccggcctcatgaattgagggaagtgggggcgcctcaggcgattaaccagcattttctgttcggtaactttgttaagtttttcacagactcagctcttcctgaggaaaaacctcaaatgcttagctatatcagaacattggccggcagatccgtaagtgaagccgggaagcgcccgatggggccagtccatatcaatgtgccgctcagagagcctttgatgccggatttatcagccggaccttttgaaagaatgagaaaggggaagcacgtctcagtcacaacagggattcagtcagctgatcaagactctctctgtcatattacagagcgtctcgcgggtaccgaaagaggtatgatcgtctgcggcgaaattcacggtgaagcagaaaagcagcaaatcatcgcgcttgccgagatgcttcagttcccgattttggctgatccgctttcaaacctccgaaacggggagcatgataagacgctgattattgatgcttatgactcgttcttaaaagatgaagaaataaaagaggcgctgcgccctgacgctgtgatccgcttcggtccgatgccggtttccaaaccgctctttttatggctcagagacgatcctgccattgagcagtttatcgtcgatgaagacggaggatggagagatcccacccaggccggcgcgcatatgattcattgccatccgtctgtgtttttggaagcggtccgttcagctgaaaccggaaaacggccgtccggatggcttgagaaatggcaatttgtcaatgaccggttccggagtcatttacaggccgcgagcatggatgatttatcatttgaaggaaatgtatatcgtcagcttcagcaccttgtccctgaaggcagttcgatttttgtcggcaacagcatgccgatccgcgacgtggatactttctttgaaaaacaagatcgttccttccgtgtctatgccaaccgcggcgctaacggcattgacggagttgtctcctcggctatgggactgtgtgaaggtacaaaagctcctgtcacgcttgtcattggagatttatcgttttatcatgatttaaacgggctgttagcggctaaaaaacttggaattccgcttacggttattttaataaacaatgatggcggcgggattttctcgtttttgccgcaggcatctgataagactcattttgaagaactgttcggtacgccgacgggtcttgatttccggcatgccgccgcactgtatggcgggacgtatacttgtcctgagacatgggaagcatttaaggatgcgtatcagccgcaggcggacaagcccggacttcatataatcgagctgaaaacagatcggacatcaagagttcaattccatcgcgatctgctgcaggccgcagtgcgggaagtgaaaaaagaatggaaactgtaacagttaaaacggccgacggcgtatgctatcgtgctgctgatagcggacacggacacgaatcgtctgaagctattgtttgtctgcatggatttacgggcagcaaagaatcatggatgtttttacgcggcatgtttcccggcgagcgaatggtgatgattgactgcctgggtcacggggagacagacgcgcctgtgcaagcggcaaggtatagtgcgagccggcaggttgcggaccttgccgccgtttttgatcaattaaaacttcacaaagtgaaacttattggttattctatggggggaagacttgcgtattcctttgcacaggcatttccgcatcgggtgtcagcgcttgttttggaaagtacaaccccgggcctcagcacgcttcaggaacgcaaaaaacggattcagtcagaccggaagcttgctgactttatattgcgggaaggtgtaacatcgtttgttgattattgggagagcattccgttgtttgccacgcagctttctcttccggacagcgtaaaggcgtccatccgtgccggcaggctgaagaataatccgtccggacttgcaggaagcctgctcggaatggggacaggctcacagccttcctggtgggaggcattacaccgcatcaaggcgcccgtcctgctcatatgcggtgaatgggatgaaaagttttgcgctattaatcaaaaggtgcataacctgctcccatcaagtaaaatagaggttgtcaaacaggcggggcacacggtacatgtggaacagccgcgaatttttggtaagatagtaagtgagtttttatacggcttgtaaagcataaagaaaatagcttttcggccggactcaggcaaaaatgaaggaggtcatatcaatggctgcagaatggaaaagtgaacgtcagtacgatgaaatcctgtacgagacgtataacggtattgcaaaaataacaattaaccgcccggaggtacataacgcatttactcctaagacggtatcagaaatgattgacgcgtttgcttgtgcgcgtgatgactccaatattggtgtcatcgttcttgcgggagcgggagataaagcattctgttcaggcggagaccaaaaagtccgcggtcacggcggatatgtcggagacgatcaaatcccgcgtctgaatgtgcttgatcttcagcgtttgatccgtgtgattcctaaaccggtcgtagcgatggtatcaggctatgccatcggcggaggccatgtgcttcatatcgtctgtgatttaacgattgcggccgataacgcgattttcggtcaaaccggcccgaaagtgggtagctttgatgccggttacggctcaggttacctggcgcgtatcgtcggacataagaaagcccgtgaaatctggtacctgtgccgtcaatacaacgcgcaggaagcgctcgacatggggcttgtcaatacggttgtcccattagagaaacttgaagaggaaacaattaaatggtgtgaagaaatgcttgagaaaagccctacagcccttcgtttccttaaagcggcatttaacgctgatacagacggcctcgccggaattcagcaatttgcaggagatgcaacgcttctttattacacgactgacgaagcgaaagaaggccgtgattcctttaaagagaaacgcagtcccgatttcggtcaattccctcgttttccgtgatcagatgacactacgaaacagcttgagccgctctggtccaagctgttttcttttcaaaaacagtacttttacctcggagatgataacatgctgacagaacagccgaattggctcattcaaagggctcagctgacaccggagagaatcgctctcatatttgaaaacaaacagatgacattcagagaattatatcatgcttctaaacaaatggccgcgcggctgtccaaatactgctcgcttaaaaaaggagacagggccgcgattttgctttctaacagaccggaaatggtttatgccgttcacgcctgcttcttattaggggcggaagctgtgctgttgaatacgaagctctcaaaacaggaacggttgtttcagctcgaagattcacaggcaaagcttttattgacggaggacggtttttgccgcgaagaatatgaatctgcggtcgccaccgcagatgtggacgagctgcaggctgaagaggcgggtgacatggagccggaagcttatgtaacgcttgatgatacggcgactcttatgtatacgtcaggaacaacaggaaggccgaaaggggtgcagcagactttcggtaatcattattccagcgctgtatcgtctgcgctgaatctgggggtcacggagcgggaccgctggcttattgcgctgccgctgtttcatatcagcggtctgtctgcgctgtttaagtcggtcatttacggcatgcccgtcgtgcttcatcaaaaattctctgtcactgatgtgctggacagcatcagctcccatcaggtcacgatcatttcagcggtgcagaccatgctctcgggcctgcttgcggaaactgaacaatgtcctgaatcactgcgctgcattctgcttggcgggggtccggcaccgctgccgctccttgaagaatgccgcaggaaacaatttccggtattccaatcttacggcttgactgaaacctgctcacagattgtcacactttctccggaattcagcatggacaagctcggctcggccggtaaaccgctgttttcatgcgaaattagaattgaaaaagacggaaacccttgtgcgccgtttgaacatggtgaaattacggtgaaaggcccgaatgtaatgaaagggtattatcatcgtgacgacgcgaaccaggccgcttttcataatggatggttcaaaacgggcgatcttggctatttggatgatgaagggtttttatacgtgctggacaggcggtcggacctcatcatttcaggcggagagaacatctaccccgcagaagtggaagcggcgctgcttgcccatccggctgtagcggaggccggtgtttcgggagccgaagatccgaagtgggggaaagtgccgcatgcttttctcgtgctgacttcttctgtcagttctgaggagctgaccgccttttgccgtgagcggcttgcaaaatataaaataccagctgcttttttcaaggttgacgggctcccgcggaacgcgtccaataaactgatgaggcatcggctgaatgagcttcgtaaaggagaattgtcatgattaagattgaaaaaatcaccctttatcatgtaagtatgaggctgaaaaaaccgtttaaaacaagtattgaaacgctgcaggatcgtaaatttttgatcgtggaagcgatcgacgaaaccgggagaaccggctggggggaggtatcggcgttttcttctccgtggtatacagaagaaacgattcagacatgcgcgcatatgctgagagattttttcatcccaaatgtcgtaggccgcgcgtttttccatccgtcagaagtgcctgacagtctcgcgcgtttcaaaggaaaccgcatggcaaaagcggggcttgaatcagccgtgtgggatctatatgccaagaaaaaggggatatctctcgcagaagccttagggggcaaaagagataaagtgcccgccggcgtggcggtgggtctggcttcggctgatgagatgcttcgggaaattgagcaatacgtaaaagaaggttatcaacgtataaaaataaaaattcagcccggccatgacgttgatctggtcagagccatccgcagccgttttccgaacgtgccgctgatggcggatgccaactcggcttatgaactgaaagacatcagcaggctgaaagagttggatgaattccagctcatgatgatagaacagccgcttcaggcagatgatattgtcgatcaccgccacctgcagaaacacttaagaaccgcggtatgccttgatgaaagcatatgctcttatgatgacgcaaggcgggcgattgagcttgggagctgtaaaatcattaacataaaaccggcgcgtgtaggaggcctgacagaggcattaaaaatacatgacttatgcagagagcatcacatgccggtttggtgcggcggaatgtttgaaaccggcatttcgagagcgcagacagtcgcgcttgcttcgctgccgcaatttacgataccgggtgatatttcctcatcagaccgatactgggaggaggatattgtcactcccgatatccgtatcgaagagggattcatctctgtcccggacggtcccggactaggtgttgaagtcaatcaggaaataatgagaaaatacgtcacccaaatggacgtttttacgacaaacaactgataaaaagacatttcagcgagttgagctgcctgtacgctgctgttatattgaagctgttcattatcaccccttcccccgtttgaaccggctgtatcagccggtttttttaataggcggatgcgatgatttttttattcttcaaacagtgccggctttacaacgcaggtgctgctttccggctggggcaaacatgtacatcttgataaaaaattctgagcttgtcatgaatgcgatactgattgtaccgtctgccgcctatatttgccgccgaaccgcctttttgccatgcttctcatccgcgcggttttctccggctcagggaggcttgcggcggaaatgaaaaagagctgtataaaacagctcttttcttttataaatcttgcggtttaaaggttttgcaatccgtttcttcacttttttcagcggtttcgcctgtatggctgaccacataaatagcgtcggccgtgcatttgtttcctctgccccaatatgaacagttattgacttcacacagaattttttggtccatgctggctcccctccaagataaaaggtacgccattagtatgagccgccctgatttttgttattcctcctggcggatataacgtctgtctttcataaagagcttccagaagaaataaaacccggggaacaaaatgatgaaagcgacgatatacgtcataaacagcgccctgaaggttgccggctccgtaaatcctgacatgaccgtaatatccggataaatcatataaggaagatgagcccgtccgtatgcatagcttgccagaaagtattggagcgcaatggcgatcatggcgattctcggtttgccgaggttgcggccgaagcgcttattcggcaaaaacagagccacgccggcaatgataaatgtaatgacagacagaatgagccatgtcttgtctttcatcatccccgtatacagccagccggcttcagagcgtaatgtcagcataatgaagaaggcaaacagaagcgacagcggccctgttattaaagagctccgtctgtagatgcggtacgcatgctcctcttccgcaacatttgaaaaatcggccagaagcagtgaagataaaaataaagtgcttaaaatggcaaagccgataaacgcatacgcattaagacttgtaaagacatttgccaaattcaggtgatacactccgcccgtcttctcaataaaccctccgtgtgtgaccggaaggaccaaaatcagcacagcgggaataatgaagcctgaaattccggagatatatctcatgatttttctttccttcgccgtattggagaagacgagaaagccgctgcggatggctaagagcagcaaaataatacttcccgggatcaataaaacggttcccagcacgaaggttgcccctggaaagaagctgaatagggcgacaacgatcgcgacgataaagacgttggtcacttcccatgtcggggacaaataacggttggcgatgtttgtcgcctttgtttgttctttatttaaatatatcatcgaccaaaagccggctccgaagtccatcgttgccatgaccgcgtagataaacacgaagccccatacgattgatatcgcaatgagagcatccatggtaatgtccatttcaattcagccctttctattgttaggattccgccgcttttacatcctcctcaacaggatgtttgcggaaataataaagcagcacataaatgactgcggctgccaaaatggcgtaaaccactgtgaacaggatgaacagcaaaccgattgaaccggttgtcgtgacgacatcagacgttttcaggagatggtaaatcacccatggctgccgccccgtacaagcgaatatccacccgaattcaattccgatcagactgagcggtcctgcggttaaaaataaaatcaaaagccaagtcggaaagctgtctttctttaaaatttttctccacacgatgccgatgatggagtacaaaatgagcagcatcccgatgccgaccattccgttaaacagtgtatggatgaataaaggcggccactcgtctttcggaaacgcgttcaatcctttgacgacggtatcaaagctgtttgcggccaaaaagcttaaagcccacggcacttctatcgcccattttactttttcttcttttgcatcagtaaaacccccgatcgcaagcggagcgtgtgatctagtttcaaacagcccttctgcgcccgcaagcttctcaggctggtattcgtaaagaagctgggctgactcgtgaccgtttaaagaagcaataatagagaatatcccgccgatcgttaaagcgagcagcagcgcttttcggtgaaagcggtatacctgctcctgttttctcgttctcagcattttataagccgcaactgacgcgacgataaatgcaccggtcatgaaagccgtcagtacgacatggcccgcggtggtgaaaaagcttggattaaaaaacgctgcccacggttcgacgtcagtgattttgccgtttaaaattttaaagccggccggcgttccttcaaatgcgtgaacatttgtgattaagacggcggatgccgcggcgccgatcaaaacgaaaataacggcaatgatgcgcatcgccggagtcagccggtcagcggcgtagacataaatggacataaacagcgcttcgataaagaaagcataaatttcaatctgaaacggaagtgacatcaccctgccgatgatctccatgaatccgggccacaaaagggcaagctgtgtacccgcgatcgttccggtcggtatcgccacgccgagcagaacagcctgcgccttcgtccaccttttcgccataatggcataatgcggatcttttgttttttgataaatcaattcggccattaaaatcatcagaggcaagccgacaccaagcgtcgcaaaaataatatgaaagcccatggttgtcccgaacagacttctggctaatactaaatcatccacgatcataaaccgcctttctaaattaccgttttatgtaatgtggttatattatttgctgaagcgattagattattcttccgattccatatatgtgcagggtttagaaatcaagggatcagggcatatatgattgacaagcgcctatttaaggtttagaataaaacgtaattattacgatttaagaaagggagatcaccatgaaaaaagatattcatccggataaccaccaagtgatttttcaagatgtgaacagcggctaccgctttttaagccattctacgaaaacgtcagaggaaacggcagagtgggaagacggaaaaacatacccgctgattaaagtggaagtcagctcagatacgcatccgttttatacgggccgccaaaaattcaacgaaaaaggcgggagagtcgaacagttcaacaaaaaatacaatatggggaaataagacaagcccaatagggtttgtcttatttattgagcactttatcatctcgtgcggggagtgacgaaatgacccgccttatgttatattgtgaataaaaaagcagaaaggaaacaccaagatgagtcttctaaacgatatcatgcaatttaatgagcagttcactaaaaacaaagattatgaaaaataccaaacatctaaattcccggataaaaagatggcaattttgtcctgtatggacacacgtcttgtagaattgcttccgcatgcgatgaacatgcgaaacggcgatgtgaaaattattaaaagtgccggcgcgcttgtcgcccacccgttcggaagcatcatgcgcagccttttagtggccgtatacgaattaaacgctgatgaagtctgcgttatcggccaccatgattgcggcatgagcaaaatcaacagcgaggatatgcttgataaaattatcgaccgcggtattccgaaagagcggattgacatgctgaagcactcaggtgttgatcttgatcaatggctgaaaagctttgattcagtagaagcgagtgttacagacagcgtaaacgtcattaaacaccatccgctattccctgacaatgtcccggtgcacggtctggtgattgatcctgaaaccggtaaacttgatctggtgatcgacggctaccagcatatggactaatgttttcgttttttgtccggtacgggatcaacaccgcccggatgaaaagggtggcactttaaaatccgcttcagtgtcagccatccgccttttaatgcgccgtgagtcttgacggcttcgattccgtactgtgaacacgtcggataaaagcggcatgacggcggcgtcagcggagagatgaacttctggtatccgcggatgagcgcaatcattatggttttcattaaaaaaccacctttctgatgctagtatagaaaaaaaatttcagattgaaaagctttcgccacaattcttatcggaaaactgtgttataatggatgcatattctgaaaaaaagggagtgccattatgccttcagtagaaagttttgagctagaccataatgcggttgtggctccgtatgtaagacattgcggagtgcataaagtcggaacagacggcgtcgtgaataagtttgacattcgcttctgccagccgaacaaacaggcgatgaagccggatacgattcatacgcttgagcacttgcttgcgtttacgattcgcacacattctgagaaatacgatcacttcgacatcatagatatctcaccgatgggctgccagacaggctattatcttgttgtcagcggcgagcctacagcggaagaaattgtagacctgctagacgctacgctgaaagaagccatcgatattacggagattccggcggccaacgaaaaacagtgcggccaggcgaaacttcatgatttagaaggcgcgaaacggctgatgcgtttctggctgtcacaagataaagaagatttgctgaaagtgttcggataaaaaacaggcctttttgctgacatgcaaaaaggcttttttacatatttctaaaaaatgtcacaccttatgtgtaagcgtttgctaaaatagaagcaaacatgaaggagtgatgggatgaaacgggctgtattggcaggtatgtgcggtatggtatttctattatcttcctgcgggggcaattcggacaaaaccgccgcggatgaggagcctaaagcgcttgaggtcaagcttacaggaccggaaacggcagcaccgcatgaaaaaacggaatacaaggcggaggttttttacggcggcaagcgtgtcacggatgcggatgaagtcatgtttgaagtatggaaagaaggaaaaaaaggcagcagcaaaacaagcaaggccaaggaggaaaaaggggcgtatcacctgcggactgaatttgatgaagagggtgtgtataccgttcaatcccacgtaacggcaaaacagcagcataatatgccgactgtaaaagtacgtgtcggggatgctgaagctgccgatgattcctccggccatgaggaacagacgcatcatcattaaggattgtttttatccgtcaagccttttgatgcgtcctccggcgggtcaatcgtatgttttacgttataagctcttacagtcgaccagatggataaaagcagcacggcgagcacgataagaaagccgaagctcagaagaagcagcatgaaatccctcctttttaacaaatcataacatattttccatccgtaaaatcaagggctaaaaatttatgttttaacacacgatatatagggtatatcaatagtaaatcaaaggaggaagataggcatgtcagaaaaactattggaagcggtcaataaacaagttgcaaactggacggtcatgtatgtgaaattacataactatcattggtacgtcaaagggaaggactttttcacattgcacgaaaagttcgaggagctgtataacgaaacggctacatatattgatgatctggcagaacgtctgctggcattgaacggcaagccgatcggcacaatgacggaatcattgaagagtgcttctataaaagaggcggaaggcaatgagagcgcagaacaaatggtacagaacatttatgatgatttcactgtcattgcggaagagctgaaaagcggcatggatctcgcagatgaggtcggagacgaaacgaccggagatatgctgcttgccattcaccagaatatcgaaaaacataattggatgctgaaagcgtatttaggataatcaacaagggaagaccggggctataaagcactcggtcttttatttggctgccgaagagaggtgttgtccatttttctgaaaaatccagtccgttccattcacttttcatagaataatgtaaggccgtttctgtgaaaggatgttggatcaagtgggcaaagactttggcatcttttcgttttttgcagtgatcgtgtcggcagcggggtttttctttggcggttttcagtattcgtttctgattttgctatcggtcatggcgattgagtttatcagtacaagcttaaaagaatctcttttgcagcagctgagcgcaagaaagctttttgcgcggctggtcaaaaaaatcgtgaccctggcattagtctcagtttgccatttttttgatcagctgcttcattcagaaggcgccatccgcaatttggctattatgttttatatcttatacgaatcggttcagatcgtgattacggcaagctcgctgggcatcccggttccgcaggtgctcgtcgacctattggatactttgaaaaataaattcaagcgcaaaccgtaacatttgcttcaaaggaggctatactagcgggtatgatggttttcctctgaatttttgataaagggcttccgaacaaacgcaactgtggtatgatgtatggaagatatgaaggaacggattagagggataaacatgtacgagtttaaagactattatcagaatactgttcagctctcctttgaacaccagcctttttcagacagcccgaagcatgtatgggtcatatgccgatatggagataagtggcttttgactgagcacgaagaccgggggtttgaatttccgggcggaaaagtggagccgatggaatgtgcggaggaagcggccctgcgcgaggtgaaagaagaaaccggcgccgcggtaagacatctgaagtacgtcggacagtataaagttctcggcagggaaaaggtaatcgtgaagaatatttattttgccgatattgaaaagcttgaaaaacaggctgactattttgaaacaaaggggccggtgctgttcagcgaactgccggagaatctcccccgaaataaaaaattcagtttcattatgaaagattcggtgcttccgatcagtctgaaaaagctgaaagaggacggcgtatttcaatcataaaaaacggagacccggcgcttacgcacgggtcttttttatatttttcctttcgtccattttctttctaacagttcgactccctgatacatcaatgtcgcaaaaatcgcgatgatcagaaggcttaagaacacaagagtgaaattgaagacctggaatccgtaaatgatcatgtagcccagacctttttcggaaacgagaaactcgccgacgatgacaccgacccaggataaaccgacgttcactttaagcgcggaaataatcgcgggggcgcatgccggcagaatgacttctttaaacatgatgcttcttttcgctccgaaggttttcatcaccttaatatagttttcatccacttcctgaaaagccgtaaagacgacgattgtcgtgataatgacactgatgactgctcccatggcgacaatgcttgtgaaattcggtccgagtgccacgatgagaatcggtccgagtgcgaccttcggcatcgcgtttaaaatgacgaggtacgggtctaaaacccgggcgagtctgtttgaccaccataacagagcggcgaggcatgtgccgagaagcgtgccgagcaaaaagccgagaacggtttctcctaaggttacgccgatgtgcgccgcaagggatccgtccgcaatcttttcaactaaaagcctgcaaacggcggagggtgagctgaagattaacggatcgatccagcccgccctgctcgatatttcccacccggcaaaaaatacgatgaaaatggcggcctgatacgcacggatccggagcttttctttttggtgtcttttcttaaactgctgatgaagctgttcaatcgtgccgctgctgtttttcaagggaattcagctccttccatatggtttgaaacagcggctgaaaggccggatcctgacgcgcgtcaaacggatctaaagccgcgagctccttaggcacggtgaatatttggtggatggtgcccggctgattcgaaaataaatagatcgtatcgctcatggcgatggcttcaccgatatcgtgggtgacgagcacggcggttttttgaaaatcctttaatgttctgaagacaaggttttccaaagaaagcttcgtttgaaagtccagcgcggaaaacggttcatcaaggagcagcagtccagggtccggcgcaagagttctggcaagtgccgcccgctgccgcattccgcctgagagctctttcggatatttcttttcaacgccgattaatccgagcttaggcagaaggctgagaacttcagctcttttttcttctgttaatgtttttgaaatgtgtaaaccgagcagcacgttttcctcaatcgatttccaaggaaataaataatcctgctgaagcatataaccgatttggtgttctttatggttcggcacgcttccttcgatcagcacccggccttgcgcaggggtgataaggccggccagaatggacaggagtgttgtttttccgcatccgctcggcccgagaaaggagatgaaatcccctttttcaatctgaaaatgtatatctttcacggcggttgtcttttctttaagcgagaaataagtatgtgttacatgatccacatgtaaaaaagacattcatgttcctcctattgttctgaggtgacttttttggcgatttttgtgttgacgagtttgctgtacggaatgtgtttcgggagctctccggcttcatccataatagattgaagcagttcccattcatccttttgcagaactgggtctgcagagaatgacttttgttttttatagcgctctatcgatgtttcgataatggccgggtctgtatcggcaaattccttctgaatcgtttttgcgatgtctttggccggatggctttccacccattgctgggcgcgatagatggcgcgggtgaatttttccgccgtcttttcattgtttttcaaataactttcttttgccataaaggttgtgtatggcacttggccggaagcttctccgaaggatgcgacgatatgaccgatgccttctttttcaaattgggatgccgtcggttcaaacagctgcacataatcacccgttccggatgcgaatgcgttggaaatattggcgaaatcaatgttttgaacgaggttaatgtcttttttcggctctatgtgattctttttcaggacgtactcaccggccatttggggcatgccgccttttcgctggccgagaaatgtttttccttttaaatcgttccatttgaatgatttctcatccttccgcgacacgagaaatgtgccatccgtctgcgtcagctgcgcgaaattgatgaccggatcttttgctccctgcgcctccacgtaaatggatgtttcagaaccgaccagcgcgatgtctgacccgtttgacaaaagcgatgtcatcgttttgtctccgccccatgttgtttgaagtgacacttggagcccttcttttttaaagaaatcttttgcttcagcgacatacagaggcgtatagaagatggagtgtgtgacttccgccacctttaccttcgtcagactttcttcctgtctgcaagccggaagaatgagcaggaaaaaggcgcatatgacaaaaacgcagcccgctttgagccatttgttcacggtgtaacctccttgttttaagcgttaaaataaccttttctgctttacatatcgtatgatgggtataaaaaatgtgtgagtgcccatattcacgttgggaaagaataaaaaaactgatgatctaaggaggcgcattgttttgctggtagaaaagaaaaggttcccgtctccgagtccgcatgtccgcctctttgcggtatgctatgagtcagaagggctgaaggtaaaggggctccttgccgagcctgcggcgccgggaacatatgacggttttttatatttgcgcggcggcataaaaaatgtcggcatggtacgccccgggagaatcgttcaattcgcttcccaaggctttgtcgtgtttgcgccttattacagaggcaaccagggcggcgagggaaatgaagattttgcgggagaggacagagaggacgcgttttccgctttccgcctgcttcgggagcatccgaacgtcagggaagggcgggtgcatattttcggtttttcccggggcggaatcatggggcttttgaccgcgattgaaatggggcatcaagcggcttcactcgtttcatggggcggtgtgagcgatatggtgctgacttatgaagagcggaaggatatgcggcggatgatgaagcgggtgatcggcggcacgccgaaaaaggtgccggatgaatacagatggcgttcgccgtttgaaaaagcagaccgcattcaggcccctgtgctgctcatccatggagagaatgatgaaaatgtttcgatcgaacacgcccggatgatcgaggacaagctgaaagaggcggggaaaccggtggaaacttggtattacagcggttttacgcattattttccgccgcaggaaaacagacgcattgtccggcggctggcggaatggatgaagacacggtaagatgcctgatttatgatatgataataaagaataagagaatgaaaggggattttcattttgggaatgcctgttgaatttaataccatgattgtgacaaaaggcaatgaaaaacggatagaggaaaatatctttttattggagaaagagggctaccgcgtctatcctcttgatattccgatggacgtgcgcaaaacgaaaaccggcgagaaatccggcaccggcgaggtccagaagctcgaatgggcgaacggccggacaagcattacatacagactcacttcgcttcattcgacaaactgaaaaaacaaaagccgagggcataaacgcccttggcttttttgattacacgagaggtccgccggttttggcaatcgagtctgcatgggaaaactttttaaagttttctttaaactcattggctaaaaacagcgctttttcgttgtatgcttgtttatcgctccatgtgttttcaggctgaagaacttcatccggcacgcccggaacatgaacgggactgtgcaggccgaaaatgctgtctgccgtcatgtcagtctggttcagtctgccgtcaatagcggccttgaccatcgctcttgtatacgaaagtttcatccgttctccgactccgtaccctccgccggtccagcctgtgttgaccaggaagacttgaacgccgtgttcgtcgattttacgcccgagcatttcggcatatacatgcgccggaagcggaaggaacggtgaaccgaagcacgtcgagaaagtcgtttgcggagatgtcacgccgcgttcggttcccgcgagtttactggtgtatccgcttaagaagtgatacatcgcctgttccttcgtcagtttgctgatcggaggaagcacgccgaatgcgtccgccgttagaaagacgatcgcctgcggatggccggcaatgctcggctgcacgatattgccgatcatctcaatcggatatgcggctcttgtgttttccgtgtagaaggaattgtcgtaatccgcttcacccgttttttcatcaagcacgacattctcaagaacagacccgaagcggatcgcacgaaaaatctgcggttctttttcctcgctcagattgatacatttagcgtaacatccgccttcaatgttgaaaacgccggaatctgaccagccgtgctcgtcatctccgatcagtttgcggtccgcatcggctgaaagcgtcgttttccctgtgccggaaaggccgaaaaacagggcgacatcgcctttttcaccgacgttggctgagcagtgcatcggcagtatatcctgctgcggaagcaggaagttcataatggagaatattgattttttcatttctccggcgtattcggtgcccccgattaaaatgacgcgcttttcgaaagagacaatgataaatgtttccgaatgcgtgccgtccgtctccgggtctgctttaaaatgcggagctgagagaatggtgaaaggctgcgcttgcgggtctctttcatccgtttccggtctgataaacagctggcgcgcgaataaattgtgccacgcaaattcatttacgaccgtaatcggcagtctgtatttttcatccgctcccgcgaatccttcaaacacaaacagttcatcccgctgttttaagtagctgacgactttggcgtacagcttttcaaacgcctcttcagaaatgggctgattcaccgcgccccaatcaatttgattttctgtgctttgttcacggacgataaatttatctttaggtgaccggcctgtatatgcgccggtagtggcgcgtacggcgcccgttgatgtcagcgttccttcatttcggctgatcactttttcggtaagttttggagccgataaattatgatgcacattcggacttgcaagtaatgcttgaagatctgcggttaaatcaactaatttcataaaaaccttcctttgccggtttatttgtatttcgctgaatgtggaattagtataacatatatctgaaaatagtctatactatttacggttttttgtttgtgtttttccattgcttcccgaaataaaggcgcgcaatcgctttaattcatattgacactttccgcccttttacgataagatatttcattgagcggatactcttatcccgagctggcggagggacaggcccgatgaagcccagcaaccggtttctctgtaaaaaagcaggtgaaaacactgtgggaaaccaaggtgctaacctgatgcaaggtttaatattttccttgagcgataagagtgaaaggcacacagaccaaaccctttcctcgagtggaaaaggtttttttatttcataaaatatgccaattaacattctctgatatagtatgacattgtattaagagggagcgagttccgtatcatatgagaaggtcttgcaaaagatcttttttcaggaggaaaagtgaatgagtaaaaaccgtcgactatttacatctgaatctgttactgagggtcatccggacaaaatctgtgaccaaatttctgacagtatcttagatgagattttaaaaaatgacccgaacgcgcgcgtggcctgcgaaacatctgtaacgacaggacttgtgctggtaagcggagagattactacgtcaacatacgttgacattccgaaaacagtccgtgaaacgattaaagaaatcggctacacacgcgccaaatacggatttgatgcggagacttgcgctgttttaacatcaattgatgaacagtctgcggatatcgcaatgggtgtcgatcaggcacttgaagcgcgtgaaggcacaatgagcgatgctgaaatcgaagcaatcggagcgggagaccaaggcctgatgtttggttatgcgtgtaacgaaacgaaagagcttatgccgcttccgatctctttggcgcataaactagcccgccgtttgagcgaagtccgcaaagaagacattcttccgtaccttcgccctgacggcaaaacgcaagttaccgttgaatatgatgaaaacaacaagccggtccgcatcgacgcgatcgttatttcaactcagcaccacccggaaattacgcttgagcagattcagcgcaatctgaaagagcatgtcattaaccctgtcgtgcctgaggaactgatcgatgaagaaacaaaatacttcatcaaccctacgggacgtttcgtaatcggcgggcctcaaggtgatgcgggtcttacgggccgtaaaatcatcgttgacacatacggcggatatgcacgtcacggcggcggcgcattctccggtaaggatgcgacgaaggtagaccgttcagcggcatacgctgcgagatacgtagcgaaaaacatcgtggcagcaggtcttgctgattcttgtgaagtgcagcttgcatacgcaatcggcgtggcacagcctgtttctatttccatcaatacatttgatacaggaaaagcttctgaagaaaaactgatcgaagtcgtacggaataacttcgacctgagacctgccggcattattaaaatgcttgatctgcgccgcccgatctataagcagacagctgcttacggccacttcggacgtcatgatgtggatcttccttgggagcgtactgacaaggcggatgcgcttcgcaaagaagcactaggagaataattttatagccgcttacttaagcggctttccctttttgtagatgctgccatgcttattttttacatagcgtgaaaccaatggcgtaacaaagcgtctataaaaagggggtccaattagaaaattacacttatggaggctatactatgtgtggatttgtcggtgtttttaataagcatccattaactcaaaccgcagatcaagaagagctaatcaaacaaatgaaccaaatgatcgttcaccgcggtcctgacagcgatgggtattatcatgacgagcacgtcggattcggcttcagacggctcagtattattgacgtagaaaacggcggacagcctttatcatatgaagacgaaaaatattggatcatttttaacggcgaaatctataactacattgaattgagagaagagcttgaagcgaaaggctacactttcaatacagattccgataccgaagtgctccttgcgacataccgtcattataaagaagaagccgcttcaaagcttcgcggaatgtttgcgtttttaatctggaacaaagctgaccgcgtcatgtacggcgcgagagacccgttcggaattaaaccgctgtattacacaaccatcggggacaaagtatattttgcatctgaaagaaagagtttaatggccgctcaaaacggtattgatcttgatacagcttctttacagcaatatatgtctttccaattcgttcctgaaccgagcacgcttgacgctgaagtgaaaaaagtcgagccgggcagccagtttacgatccgcccggaaggcgacatcgcgtttaaaacatatttcaaagcgaacttcaagcctgttcagtctgatgaagataaattggtgaaagaagtcagagacgcaatctttgactctgtcaaagttcacatgagaagtgacgttcctgtcggttcgtttctatccggcggtatcgactcttcttttatcgtttcagttgcgaaagaatttcacccgagccttaaaacattttccgtcggttttgagcagcagggctttagtgaggttgacgtagcgaaggaaacggctgccgcgcttggtattgaaaatatcagcaaagtcatttctcctgaggagtatatgaacgagcttccgaaaatcgtctggcactttgatgacccgcttgcagatccggcggcgattcctttgtactttgtcgcgaaagaagcgaaaaagcatgtaacggtcgcgttatccggggaaggcgcggacgagctgttcggcgggtacaatatttaccgcgaaccgctttcgcttaaaccgtttgaacgcattccgtccggtctgaaaaaaatgcttcttcatgtggcgtccgtcatgcctgaaggaatgagagggaaaagcctcttagtccgcggctgcacaccgcttgaggagcgctatatcggtaatgcgaagatttttgaagagcccgtgaaaaaacagctgctcaaacattacaatccagagctttcataccgtgatgtcacgaagccgtactttacggaaagccgttcatacagcgacataaataaaatgcagtatgttgacatccatacgtggatgcgcggcgacatcctgttaaaggctgacaaaatgacgatggccaactcattggaactgcgcgtgccgttccttgataaagtcgtgtttgacgtagcttcaaaaattccggatgaattgaaaacgaaaaacggcacgacgaaataccttctgcgcaaagctgctgaaggggtagtgcctgatcatgtgcttaaccgcaaaaaactcggcttccctgtgccgatccgccactggctgaaaaatgaaatgaacgaatgggttcgcaacatcattcgcgaaagtgaaacagacgcttatattgaaaaggattatgtccttcagcttctggaagatcattgtgccgacagagcggacaacagccgcaaaatctggaccgtgctgatcttcatgatctggcacagcatcaatgtcgaaaaaagactggtgccggaagagctgaatcatcagccgaaagaagtcattttcgtttaatccaaaaggctttcgagttatcgaaagccttttttctattgttttttgtaaaccgtctattccgctctgttttcgacaaagtattacgcaatattcagaaaaaggttataataggactaatcgggtagattccggaaaaagttttctggctatttcgtctcggtttgttgtttctttgtcaaaatcagggggagggagagttatgcaaaacaaagaaaaaacgcttcaccgcggcttggaagagcggcatatctcgcttatgtcgttgggcgccgcgattggagtcgggctgtttctcgggtctgcttctgccataaagcttgccgggccggggattttagccgcttacgcctgcagcggactgattatgttttttattatgcgggcattgggggaaatggcgattcaaaagcctgtagccggttcattcagccggtatgccagagattatatcggcccgcttgccgggtttttaacaggctggaattattggtttttatgggtcgttacctgcatggcggaaatcaccgcggtcggcatttatatgggctactggttccctgacgtgccgtcatggatctgggcgctttgtgcactcgtcattatgacggctgtcaactttctggcggtcaaagcgtacggtgagcttgaattctggtttgcgctcattaaagtcttggcgattctgtcaatgatcgcgatcggtctggtgatgatcgtattcggtctcggaaacggaggcgttgcgctcggaatcagcaatttatggagccacggcggctttttcccgaatgggattaaaggggtgctgctgtcgcttcagatggtcatgtttgcttatctcgggattgagctgatcggtgtcacagccggtgaggtcaaaaatccggaaaaatcactggcgcgggccatagatactgttttttggcgcattctcattttttacgtcggagctttgtttgtcattatgtcaatttatccgtggcaggaaatcggttcaggcggaagcccgtttgttttgacatttgaaaaaatcggaatacccgctgcagccggaatcattaattttgtcgtattgacggcggctctttcttcctgcaacagcgggatcttcagcacggggcgtatgctgttcaatctggcggagcaaaatgaagcgcctaaagcatacggtacggtcacaaaaggcggtgtgccgggaaaagcggtattggtttcagcgggtgcgttatgcatcggcgttttgctgaactacgtggtgccggcgaaagtgtttacgtgggtgacgagcattgcgacgttcggagcaatttggacatggtcgattattttgctttcccaaatgaaataccgtaaaagcttacagccggaagaacggaaaaaactcaaatataaaatgcctttataccccttttcctcatatatctcgctggcatttctggcttttgtcgttgtgctgatggcttttgatgcagagaccagggtggccgtcatcatcggtcctgtctggttcggcatattattagccgcctattacggcaaaggattccataaaagaaaagacatagatctggaaaacggacagacattcgccgaaaaagcgtaaaaaagagcccgctgaaatgggctcttttttcataggatcgggtaaaagggggaagaataaaacaaattcctgaacattttgcttctgtttcctgacaatcgggagaatgcaaatggtttttacttaaataatattttgaaaaatggtacagtagtaaaacaaagctgatcttttttatttctcttgcattgttttatagtatcggcctttttcaacatattccgttctgattctttccatgtcccgtatgtcttcttctgtcagccggcggataacctttgcgggccggccgaacgcaagacagccgggaggaatggttttgcccggaggaacgagacttccggcgccgataaacgcgccttctccgatttccgccccgtcaagaatgacggagcccataccgattaaagcattctttctgatgattgcgctgtgcagtgtaacctgatggccgatcgtgacgtcatcttcaataagaagcgggcggttcgggctttgatgcagacagctcaagtcttgtatgctgactctttttccgatccttgtcggcgcaacatccccccggatgactgccgagaaccaaatgctcgattgttctccgatcacgacgtcgcccgttatgacggcgttatccgcaatgaacgcttcaggatgtacgtcaggcgtaaattgtttataagggtagattatcatgtctcatccttctttctctaaatttatgtaagaggtgaactgcatgtggacttggaaagcagacaggcccgtcggtaccattgtcattatccacggggcgagcgaataccacgggcgttataaatggctcgttgaaatgtggagatcttccggatataacgtggtgatgggcgatttgcccggtcagggaacgtcgacccgcgcccgagggcatattcgctctttccaagaatacattgatgaagtagatatatggattgataaagcgagaacgcttgaagcgcccgttttccttttgggccacagcatgggcggactgattgcgatagaatggtttaagcagcagagaaatccccgcattacggcactcattttatcatcaccttgtctgggtctgcaaataaaagtcaataaagtccttgattttgcgtctaaaggactgaacgtcctcgctccgtccctcagagtggattccggcttatcacctgatatggcaacgaggaatgcggatatgattgaagcggatcaaaacgattctttatatgtcacgaaggtatccgtaagatggtacagagagcttttaaaaaccattgatgccgctatggtgccgactgatgcgtttttaaaggtgccgcttttgcttatgcagggcggtgatgacaaaatcgtcgataaaatgaaagtccgcaaatggttttccggtgtggcttcccataataaatcgtaccgggaatgggaagggctttatcatgaaatatttaatgaacctgaaagagaaactgtgtttaaggcggcaaaagcctttacagatcagtatatttgaattcgctgggggtgcatatgttgacagtaccggaacatccttttaaccttatggcaaaagtgtatcgggaaatttttccgctcgttcatcaggaattgaacatgtggcgggaaaaatcagattccattaaaaataccgaactgcggcagcaggcggccgcaagtatccgcgataagtcgtttcattgtgaaggaggcggcattttagccctgctttcgggagagcagaaacagaaatgcgtgcaatttatcatcgcgtatcagacaatcagtgattatctggacaatctgtgcgaccgcagcacctcgcttgatccggaggacttccgcatgcttcatctttccatgcgtgacgcgctgacggtcggtgccgaggtgcggccgtactatcagtacagagaggagcgggatgacggcggttatcttcatgaactggtcagaacatgccagcgggtgctcgggtcaatagaacattacggtatcattaaaccttatttgcttgaactgtgtgattattattgcgatcttcaggttcataagcatgtcgttgagcatgaacgggttccgaggcttaaagcctggtttgagcagtacaggtcgcagcttccggaaatggagtggtttgaattctcggcctgcgccggatcgacgttaggcattttctgtctcgttgcttactcattccagcctgattttaacgaacataccgctgagaaaatccgcagcagttattttccgtacatacaaggcctgcatatactgcttgattatttaattgaccaggaagaagatctgcttgaaggcgatctgaatttctgtacgtattatcagtctcatgaagaaatgatgcagagactgcagcattttattgaaaaagcggatgaacatttgcaaggcattccgcatgaaaattttcaccggctgatcaacagggggctgctcggcgtctatttatccgatgacaaagtcgccggccaaaaagaaatgggccgcctcgcgcgaaagctgatcagggcaagcggaaaaacgtcatttttcttttatatcaacggaagagcctaccgcaaatttcagaagatggcttggacgaaaagttcgtaatgggtgaactgcgcctctcgtgtacatcatgacggcgcagttttttatttatgatgtgaagaatgaaacattgtgtgcgcctgcagaatatgatactttaattttatgaaaaaattaaagtatttagcggtcatagcattactttccatttccggaggctgctccgtcacccatgcttccgccggctatcatcctgtcttgatagcgcacaggggctcttctgcgattgagccggaacataccgctttgtcttatgcacgtgcgattaaagacaaagcagattatattgagatagacttacgggagacgaaggacggccgtctgattgcaattcacgataaaacggtagaccggacaacagatggtaaagggatgacagatgatctgtctttggctcagattaagaaactgaatgcgggaaaaggagaaaagattttaacattagaagaaatcatacagaaattcggacaaactgccaattactatattgagacaagagaaagcaacggcagcctggtgatggaaaagaaactgattgacatattacaaaaacataagctgatttccggccataaagcagtcattgagtcttttagcgggaagagcttaaagaaagttcgttctatgaataaaaaagttcctcttgttcgattattaaaagataacgaggctgaggagataaatgataagcagctgcaaaccatcagaacgtatgctgatacagtcgggatcaacgccaaattggcaaatgaagcagtcgtgaagcgcattcatcacaataagatgaaagtgcacgtgttttttgataaggaagacgagcatacgctgacgcctattatgctgaaacaaaaagcagatggtgtctttacgaacaatcccgcttatacacgcagcgtgctgcaaaacagtaaataaaaagagacatgcgcattttacgctgtctctttttttaacggtttcttttttgccgcaaggtgcattgcgaatttgccgatcagcccgatgacaaaaaatgcagcaaaccaccagtaataggttttcgcgaactcaaatcctaaatgtcttgataaaatgatgacaaacatcacatagggaacacttgaaaatatgatgcgaagaatattcaaattgccgctcctcccagatgttacacttaaaagatgaacttttttccattatttcatagtaattgatttttcttgaaaagtaaatacaaaaagaatcggcccgcttatgacaggccgattctttatttgccggcagatttcttttcaatcgctataataaacggcgggtcgttttgctggttgagaaagccgtagctcagcacgcgggctttttcctgatcaagattgctgcagtattccagtaatgcacttttttccgtcttgccttcaggatgcccgtggtacacaacgagaacgatcagcccgttctccttcagcagttcaaggagctgttcgatcgcggaaatggttgagtgaccgtttgtcgtaatgcttttatcgccgcctggcagatagccgagattaaagacggcgcaagccacacgaccgtgcgcatcttcaggcagcgatgcctttatttgatcatggcttttatggtgaagcgtgacgcgcgggccgaagtcggcaccgagccgctccttcgttttagcgagtgcgtccgcttgaatatcaaaggcatggacatgtcctgtctcaccgacaaggccggccagaaaatatgtatcatgtccgttgcccatcgtcgcgtcaaccgtgatatcaccttcctgtgcggcggacttcagcaattctttactgaaagggaggatgtgcatcaaggtcatagggcggtctcctccccggtctttctgaagagctttccttgatagcttccccgtgtttccagctctttttgaatggcgcccagtacttcccacttattgacgctccacatcggcccgaccattaattcgattggcccgtctcccgtaatgcggtgaacgatcatttccgggggaatgatttcgagctgatcacatacaagacttacatattcttcttgagaaaggaactccagctttcctttttcatattgcttcaccatcggtgtgccttttaataagtgaagcaggtgaattttaatgccttgcacatccaaatcagcgacggctttggccgtctccatcatcatgtccctgttttcaagcggaagcccgttaatgatatgggaacaaacgcggatgccgtgttttctcagtttattgacaccctcaacatagcagtcaaaatcatgggcgcggttgatcaggagtgcggtccgttcatgcacggtctgcagcccgagttcaacccacaaataggtccgctcattcagttctgccaaatattccacgacatcgtccggcaggcagtccggacgggtcgcgatagacatgccgacaacgccgtcaagcttgaggacggattcaaatttttcacgcagctcctctaccggggcatgcgtattcgtgaacgcctggaaatatgcgatatatttaccgtctttccacttttcgtgcatacggtttttgatatcgtgaaattgcgtgagtaagtcatcggcccggttgccggcaaaatcgccggagcccgccgcgctgcagaatgtgcagccgccgtgtgcaaccgtgccgtcccgattcgggcagtcaaaaccgccgtcaagcgcgactttaaacactttatgcccgaaatgctcccgcagatgataatttaatgtatggtaccgtttttccgtatttgaataaggaaaagggttattctcgttcaatgttcaaaaagcctccctcacatcagatgcatcctaaaattgtagcatgaatgatggggcggaacaatgaaacaattatggaacggtcaaggcgtaatatctacctggtttttctgttgttgttttaatcgttttggagaaatatcactgaacaatgcaaaaataattcctaaaataagaattacactgcctactttgaatgtattattaaaactgtcacttattttttcattatataaatttgaaatttttttctggatagcgataacttccttcttttgagtattgaaacttttttgtaccttttctttatatggatccggggttatagaaagaatttcttcctcttttttgtttaattcagcaatactttttcttcgatcgaaacctttactgtctgaatgctttaagtgagttattatctcgttttttgcatttttatcaaaaacctgattgttttccacaattgttatggcttctttttttgcagaagctgtgtgatcatttatattcattgtaagcacagatgtaagtatggcaatgcctagcgcttgtccaactgtccgcatcatattaagaatacctgaggcaatacctactttctcaggaggaataagccgtatccctgaactcattgccggtcctatcacaagccctaaagctaagccggtcaaacataacagaataactaccgttgttacagaactgtcgtatcgtatgtatccatataaatatgttgtgattgttaaaccgagcatacctagacccgaaagccaaatgcccccgagtttatcagatagctttccagaaagtacagaggtaaacatagatgatagagctaatgtagaaacaattaaccccgcttctaattcagtttttcccattaaattcgtgaggagtaaagtaataataagggtaccgcttgttaatccaaggccctgcataaagagggtgaaagaactgaaactaaacgtacgtatcttcagcatggataagggaatcatcgggtttttaattttagattcaataaagaaaaacaaacagaataataatacagagattacaaaaagagagataattaatggtgatgaccagcctaaatcagatacttttgcaaagccaaaggttaaacagaagagagctccggataaaataagaatccccatgtaatcaatttttttactcactgtttcatcataactctcagtaataaaaaatgctgctaaaaaaagagaaatcaggcctaaaggaatatttatgaagaagatagcttgccaattaaaattttcagttaataatcctccaagtacaggtcctaaagtagctgctaatcctgagaaagccccccagattccaatgatcaatccttttttattttgaggaacgatggccaaagcaataggcattgtaactggcacaatgaaagcagcagataatccctgaatcactctaattgtgataagcatttcaattgaagtgctcaaacaggcaataactgatgtcaaaataaaaagtgctaatccaaacataaaagctttttttcttccaaaatggtctgccagctttgatgcacctactaataaaactgcaaaagctaaagtataacctgtagccacccaagctacttgagaaaggttgctcgaaaagtaatccagcatcttaggtaatgcaatatttactatagtggtgtccattaccgaaatgaatgtacctaataataatgcagataacataattaattttttgaaattcaaaactacaacctccatcagatattaatctaaattaaaattcgatatatatctaaaaacatgataaatgcaatcttaagaggtgtcaatattattcataaattgttttttcatccacttatctcgaaatcatatttttataattcaacaattttgtaacttgaaataactcaataagagcttaaatggacctgtaaactagctgagatgattaaggatttctgaagagtatgacatgaggagaatacttagcatgaggtgaagcaagtctaataaatctaggactgctcatgataatgctcagtcaggtaagtgctaattagaaatgaatattctttgaaagtttccttttgattgataatattaaaaatgtaaaatgtctggcatgaagatagtacaacgttttcctttgtggaaaaagactttatggggtgtgaaaaagtgcggttaataataaatgacagtgtttcagaattctttgacaagatatcctctattctattcttaaaacacgaggaattcttcaaagattatacaaccaaattgggtttgaatttagataatgaatattttgtattattagatgatcttaaaagaataaaagagttagatagtgagtttttaaatttttattttggcagcttttgcgactacaaagatgttaggaatgcaaatattttttgtttagccacaacattttttaaaataccacaaatttacacgaaagatttttttgaaattattgattatttgtctgcagttacagaagaagagataagaaaaaatattttagagtctctaatttatttacaaggagatcttaaaaccgaaacatctacccaacagtatttaaatgatagggaaagtttatttgagctacttaataatctaaatataaagcccgaatacaagtggatcatatttaaggtaatgaaatctcctaaaacttatgtagatcaattttgcaataaattaatgttggtgaatggttatcttaacgaggcgatttataatttaattaaattcagagatgagtggatgaatcaattaaaaaacataaatatagattttccaaaaaagataatcagtacgttaaaaggtaaggaatacttatcttgtaattatattaatatatatccaacacttttaccttgcactgcaactattacgaaaagtgaagataacatttatgttggactgggttataaagttgataaaatatttgaaaatacattagagaaagcagagattaatcatatcattgattttttgaagcttttatcggataaaagtaagttcaagatattaatcttacttagtcataaaaaaatgtatgctaatgagattgctgaacagctaaatttaaccaacgcaacgatttcacatcatatgagaattttgacattgcaaggtttagttgagagtacgagaaatcaaaataaaacatactattatcttaattcttcaaaattcgattcacttttgaacggtttgttgaaaaaatttaaagctgttccagtcttagatggggatgagtaagttttatagttggtgttagtttcgggatgataattaaagctaataaaaacagatctaaaaaatttgatgaatcccgggtgttttacacaaaaaagataatttaatggtgaacaatttaaagcgaaccgaagatcttgtgggtgatgtggaaaaattatgatgtttttaataaaagaagaattaagttatcgttctaaaatgaaggatttttataaagacttcattctgtcttgattaagttttacatttaatcgtattttatgccatctctgtcttgtgaatgaattacctgatatttcttgtgagaattaatttggaataagaaatactattgatatgacattatcaataggaggactgtttaatggcaacaagacaatcagtagatgaacatctccaaagaagcgaacaggcatatgaatttgcgaatgagcaatttatgaccgcttcaaaacaagagcattataatgataatgagtacagtgaagcgcaaatgatgcttgaaaacgcggtgaatgaattaaacaagctgtcattatctgcgaatgatcagcaaagagagcagctttaccgaatgagattgcagctgcagaccttgcaaaacaacatgattttgcagcgtaattttgattactgaccgcgccgtttcaaatggttcagcaaacctgccggaatcccggcgggtttttttgtatttttttaaaaaaagaattgacaataggcctgagtgtgtttattgtattacgtgtactacttgatgtaatacacataaaacactcgaaaaatgaatcgacatataaatgttaagcatagggaaggggaactttcatgaaaaacaaaagatccgtaaaacaagatgtgcctcttattatcgccgcttcggttttggccagcagtctgtttgtcgttcttgtcgtcatcggttttcaatggcagaacatttaaagaaagagagcagctcgtaaaagaaagaagggaagtaaatgattcaaatcgatccgagaagctcaactccgatttatgagcagatcatacagcaattgaaagagctttgtttaaaagggatcatgaagccgggggataaacttccttctgtcagggaattggcaacgatcattatcgccaatccgaacacagtcagcaaagcgtacaaggagctcgaacgcgatggtgtcattgaaacgctgaggggaagaggaacgtatatatcggagaatgcaaaaacgacattggttgaagggaagatgacgatgataaaagagcaattgaaacagctcatcatcgatgcccattacgcgggagttgagctggagaagctgcaggaatggataaaggaaatcagcgctgatgtgaaaggaggaaaggatcatgattgaattgcggaatctctcaaaaacgatagacggtaaagaagtgctcaaggatatttcgctcaccatcggaaaaggggaaattttcgggctgctcgggcggaacggatcagggaaaacaacactgctccggctcattcagcagattctgcttccggatcaagggacggttttatttaatcaggtggaaataaagcgtcatccgaaagtcaaacagaacattatttatatgcctgttgaaaatcctttttatgacaagtatacatataaacagcttgttgcgattgtaagcagaatctatccgaattttgatgtgacttacgccaatgagctgatgaacaggtacggcattccggaaacgaagaaataccgtgaattatccacaggcctgaaaaaacagcttgcgctcgtccttgcctttgcttcacgcccggctcttatccttttggatgaaccgacggacggaattgacgccgtaacgcgtcatgacgtgctgcagcttatggtggatgaagtagctgaacgggaaacgagcattctgattacctcacaccgtttagaagatattgagcgaatgtgcaaccggatcgggtttttggaaggaaatcagctgacgaatgtgatggacttggatgatatgaaggaagagtacatgaaaatccaaatggcatttgaagaggacgtcgccttgaagatcagagaacaaaatataccgattctcgaccatgccggtgtgttttatacggtgctgattcaaaagaacgatgagaagaaaaagaactttctgcaagagctgcagccgaaagtatggaacgaacttcctgtgaacttagaagaagttttcatcgcgaagtttggaggggaccggagatggtagacaggggattgctgtacagggaatgggtgcagaatcgaactgttcttgtgatggtcggcatttttttagcggcggtcaatccatttgaagtgttaaatacctatctggtttatcaaggctgtctggacacccacgaagcatattgtaagttttatgtgaattctttggatagcggaatgctgaacttaaactgggcgcccgctgtgattttggcggtttgcttattcggactggaacgtacgaaaggaacgattgatgcgcttttcagtctgccttattcccgcgctcaggtgtttcacactaaattttggctcggagcggcggtcattaccggcgctcaggtgatcggctacgggctggctgagctgctcattcttctgttaaagcctgagcgcgtatatttcttccaccattacagcgtcggagagattattgtgagtgttttggcttttacattggtcgcgagcgcaggctgcttaacggggaatacgttcgcccagctgttaacggcgtttgccgtgtcgatagcgccttacctgattattacgttgccgctgacaaatgcggaagttatcttcagggtcggcatgcatgagctgatgccatcagtcaatgcttacctaaacgattcgtttcaatatctgattccgatcatgtatgttaatacggactgggtatctgccagcaagtatatattaatcattccggcagtgatgagcattgtattttatgccatcgggtacttttgctatgtcaggcagccggtggaacggaacggccgtttttttctttggagacagcttgaccggcccattcagattgtggtgatcatcatcgccgttctcggttttggcctggcggggtactcgacgggacatacgatgacagggtatgtggccgggatgctggtcggaggagcgatcggatttttggtcagttattttgtgatttataaaaaaacgaagcatgtgtaagagaggaggaccggaatgataccgcggggattgttgtacacagaatggaaaaaaaatcagtggttgtttttatgcagcggcattcttttaatggcggcaaacccttttatggtttataacaactactcaacatatcaagaatgtttgaataacccagctcttcaagattgtgaattcgttgtcaattatacgaatgggtcgcctctttccttcagctgggttgtgagtgtcatcattgctgtcttcttattaggcttggaacggacaaagggaacgatggatgctttgttaagcatgccttacagcagaggccaaatctttcagacgaaattctggctcggcggggcagtcattgttgctcctcaggcgataggctatggagcggcgtcattgctgatatctttgttgaaaccgagccatacgtacgattttgatcatttttcaatcggaatgattgtcatcagctttatggcttacgccttgttaatggcatccggagcaataacgggacatatattcgcccagctgttaacggcgtttacagtaacggttctgccctttttactcatcggtctgccggccgcgaatttggaggtcgttttcgattttagtgtcggagatcaattttcttttatcagcagttatatcgaatcccgtctttttatatttataacccctattggatatgtgtttaacgactggatcagagaaagagatttgattttaatcattccgattgtgatgagccttgtcttttatctgatcggttacgtcagctttctgaaacatccgaatgaacggaacggcagattctttctttggagaaaattggaccggccggtgcagatcttggtgattgcgtttgccgttatgggtttcggcgttttcggatatggggtcacagacacgatgttcggctatttagccggcattatcttcggcgcggttatcgggtttttcatcagttattttacggtttacagacagtcaaagcatatgtagatccgtttgaaaatgagcagtttggaggaaggcaaggtgccgattagcggtttgctttataaagaatgtaagcagcggcagacgctgctgctgcttacagcggggttcttatctatcttaggccctttggcaattataaatgagtattttcactataaggattgtttacgtgcacttcagctgtacccggggtcagtttgtacattcagcatcgattacagcaattatcggaatttgattgggcttcatttcattccgccggttgttatggggctttttctgataagagcaggccgggctgaaaggatgtttacactgagtcttccgtattcgagaagccggatatttcatacgaagtttttcttgggagcagccgtgttagccggctcgcagtttgtttcttacggagtatccgacatattgttcctagcgcttaaacctgacgctgtccatcattttcaatcattcagcgcagggatgctggtcatcagcttgatgatttacgcattagtgacagctgccggcacgataacgggcaatttagcggcgcagctgatcacagcgttcacggtttccgtctttccgatcgtggttatgacgatttatctgttaaacgccgagttcctttttggcaggcaggctgtgccggatattgatttcccttggagcggatttctgatctatttcatgcctgccgcttacatccatacatcatggatgtattacatgaaacacgcattgttcatctccgcattaatgggattttgtttctatctattcggctatgtgaatttcctgaaaatgccgaatgaacgaagcggacattttatcctgagcaaacacattgaacgcatcattcaagtgctcgtcatgtcgctcagtatgctgggaagtgcgggggtatgcggatatgcttataacggttcgtataccggttacatattcggcatgctcatcggtgcgattatcgggtttttcatcagttattacttcatctataaaaaaacgaaacagatataagggggagtggtgtacgtgatagaggtacagcatatcgatcattcatttaaaatcggcaggaaaggcagagagagtgaggttccggtactgaaggatgtctctttgaccgttgaaaaaggggaaattgcctgtatcgtcgggcggagcggttccggaaaatcaacgcttctgaatttaatttcgggatacatagcgccgacaaagggccgtatcgtcattaacggcactgatgtgacgggtttcaatgaaaaagagtgggcgcagttccgcctcgggcatttcggctttatttttcaaagctttcagctcatcccgagtctgacaacctatgaaaatgttgaaatgccgcttgccttaaaaggtgtcaaaccgtctgaacgcaagcagaaagtcgcggatatgctgaaacgggtcggacttgaaaatcatgcgaatcattatccgaatgagctgtcaggcggccagcagcagcgtgtcagtatcgcaagagccctcattttaaatccgtcaattattttagccgatgagccgacgggaagcctcgattcagaaacggaacttgaggtgcttgcattaattcagcagctgaaccgggagcgcgggattacatttgtcatcattacgcatgacgatgaagtcgcttcgatcgcgcattcaaaattccagctgcatgacggtgtattaaaagggggcgttactgttgagatttaaggatcagattcactttatcagaagaaatatgaagaaaaaccggctgcgtgttttcatgacggtgctggcgacgacaatggcgtgcgcgtttttagtggtgctggcttccgtcggattcggcatccaaaaaacgattacagacattacgatgagccagcagattgttacggaaatcaatgtgctcggccaagagaacggaaaagccgtgaagaaatcagacttggaaaagtataaaaatgtcaagtctgtcgttgagagaacacaagtgtatgaaccgaacaaagcgtcattgggaaaccgaacaaatgaagattcagccattgtgctgacaaacatgaaagatgaagtcaaagccaatatggagcttgatcagggaagagtcgcccgtacagagaatgaaatcgtggtcggctatgattttgcgaagaacctattgacgaaaaaagaggctgacgcttacgacaaagagttaaaggatcaccaaggcgacatgtcggaggtgaaaaaaccaaaaggctatacgaaagacctgcttaataaaacgatacagctgagcatctccaaaacaaacaaagacggagacgttgaaaaaacgaaaacgtacgacttcaaagtagtcggaattacaaaaaaaccgtcccaagattggatggaggatacaaatatttttgtgagtgatcaattcaagaaagacttctcgacattcttggatctgaagaatggaaatgcggaaaaaagcatcaatgtgtatgcggacaaattcgatcatgtcgatcagcttacccatgacctcacggatgacggcttttatgtcagatctgtcacaaccgagctgaagggcgtcaacacctttttcctcgtctttaaaatcggtctgatctttgtcggctttatcgccgtcgtgatttcagccatcggtattttcaatacgatgacgatggcggtgacggaacgaacgcaggaaatcgggattatgaaagcgatcggcgcaagcccgtccatcatccgcagaatgttcctgatggaaagcgcctatatcgggatattaggttctgtcatcgggattatcatttcttacggagtgagttttgccgtcaatctggctgtgccggttattttgaaagcggtagggggaaataccggagctgaagatcttcattataccttctcctacatcccgctcagcctcgttgtgatcgcagttgtcatttgtgcgggggtcgcggtgatttccggtatgaatccggcccgcaaagcgacaaaaaccaacgttctgaccgcattaagaagagaactgtaaaggaaaaaagccggctggacatcagccggtttttcctctatctatcagaaaagggcggataccatgtttcacattttgttaatagaagatgataacactttgtttcacgagatgaaggagagattaacgggctggtcatttgcggtgcacggaataaaggatttcagccgggtcatccgggagtttactgaaattaagcctgatttggtgatcattgatgtacagctgccgaaatttgacggctttcattggtgcagaatgatacgctcccaatcaaacgtgccgattctctttttgtcctcgcgcgatcatcccgcggatatggtcatgtcgatgcagctcggggcagatgattttattcagaagccttttcactttgatgtgttaatcgcgaaaatacaggcggtgttccgccgtgtgcaccaatacggcacagaaccggcgctgatgaaaagatggtgcggggcggtcattgacacagaaaccaacacggtcagctgtaaaaacggttcggtcgaactgaccaaaaacgaaatgctgatcttaaaactgctggctgagcagaaaaataaaatcgtcagccgggaagaactcatcagaagcctatggaatgatgagcgtttcgtcagtgataatacgctgacggtgaatgtcaaccggctgcggaaaaaactcgatcaattaggcatcgggaaaatgattgaaaccaaggtggggcagggatacatcgcaaaggaagaagacggtctttatgattaaatcatttctgctcgaaagaaaaagctggatcgcgatgtttcttttgcagcaggctgtgctcctttttgcggcatatattgatgcgtctattccgtttttttcggtgctgtattttgtttacctgtcgcttcttgtgtttcttgtatttctcttgttccgctatcgtaaagagaccgcctattataaaagcttaagagagtgggacgccaatttagacatgtcttatcttaaagcgcctgacagtccgtttgagtctatcgttgaagaaagcattgaagggcagacagagcaattacgaaaaagctcacttgatcttcaggcggcgtcagagcatgaaaaggatgatctgatgtcatggattcacgaggtcaaaacaccgctgacagcgatgcatctcatgatcgagcgccttgatgaacagccgctgaaagcccctttgctgtatgaatggctgcggattcaccatctcctggaccagcagcttcatcagaaacgattgtcctttattgaaaatgatttatcattccagcgcattcagctcagaccgctcgttttcaaagaaattaaaaacctgcaatcatggtgcatacaaaaagggatcgggtttgacattcagcttgattcaccggacgttcacagtgacggaaaatggctttccttcatcatcaggcagctgttaagcaatgccgtcaaatacagtgaagcggatgacattaccgtaaaaagctatgaacaaaacggccgggtgcatgtcgatatcgaagaccgcggcatcggcatcgagcccaaagatcttccgcgcatttttgaaaaaggatttacctcgacgcgaatgaggcgagatcacgcgtcaacggggatgggcctgtatttggctcgaaaagccgcggctccgcttctcatccagatcagcgtgcgctctgagccggaaagcggcacgatttttaccttggtgtttccaaaacagaacgatgccgtcagcatgttcagcgtgtgacaaaagtgtcacatgcttttctcttttgttcgcttaatcaaacgaaaaaaacggcttctgtttttaaaataaagataaccaatgtaaaaggagaatcataacgtgatgattttagaagcaggcaatatccaaaaaagctacggaaacaagctgaataaacaagaggtgctgaaaggaattgatcttcagattcacaaaggggaattcgtcagcattatgggcccgtcaggatcagggaaaacgacccttttgaatgtgctttcctccattgataaagtgagctcgggcaccattaaactgaacgagacggagattacatccatgaaagaaaaacagcttgccgaattcagaaaacggcatctcggctttatttttcaggattataatttattggacacgctgaccgtgaaggaaaacatactcctgccgttatccattacgaaaatgtctaagaaagaggcggacctgcgatttgccgagacggcagaggagcttgggatctatgatttgagacataagtatccgagtgaaatttccggcggacaaaaacagcggacgtctgccgcaagagctgttattcacgagccgggcattatttttgctgatgagccgaccggagcgctcgattcaaaggctgccacggatttattgaataaactcagccgcctgaatcaaaaacgccgcgccaccattgtgatggtgacgcatgatccggttgccgccagctattccggacgtgtggttttcattaaagacggccgtgtgtatacgcagctgaataaaggcggtcaggacagaccggacttttttcaggatattatgaaaacgcaaagtgtattgggcggggttcaggcatgagtattcatcatttgatcttccagaacctgaaaaagaatatgaaaaactattatctttacgtttttgcgctggtgttcagcgccgccctttatttcgcgtttgtcacgatgcaatacgatccggcgcttgatgaaatgaaaagctccataaaaggagcggcggcaatccgggccgcctctgtactgcttgtggcgatcgtgtcggtatttcttttatatgccaacaccatttttattaaacggcgcggccgggaaatcggcttattccgattaatcgggatgacgaaaatgcacattttccgcatactcagcgcagaaaatttcattttgtatttcggatcgatttggatcggtattttcgccggcttttccctctcgaaattatgtatgatgatgctgtttcatacagtcggtgtgaaagcctctgtctcactgtttttttcaagcaaggcgctcgttcagacgttaattgtgttcggggcaatttacgtgctgattatgatgatgaattacttatttattaaacggcaaagcattttgtctttatttaaaaccgcgtcatcgtcagaaagcggcataagacggctttcttgggtgcagatgttgatcggcgttgtcggtattgcggccattatcgccggctatgccgtgtccgcggatttattcggaggcagttttacgagcatgaatgaactgttttcggccatggtgtttattctcggctcggtcattatcggaacctatctgttttataaaggttcggtcagctttctggcaaatctcatccggaaatcaaaaggcgggtatctgaatgtcagtgaagtgctgtctttgtcatccatcatgttccggatgaagtcaaacgccgtattgctgacgattattacgactctttcggcgctggcaatcggtttgctgtctttaagctatatctcgtactactccgcggaaaaatcggctgagcaaaatacagccgcggactttgcgtttgataaccaaaaggagactgactcttttaccgctttattgaagaaaaacggaattgaacacaaagtaaaaacaatcaagaccattcaagccggtgtcaatatgaagaacattataaacggcgacatgaaaagctttcaacaagacccgtccagcctggcgctgccgattataagcgagaaagacgcagaagggacggagctttctgacggagaagccgtgtttaccggatataatgatatgatgaaaagatttctcgacctgaaaacgtcgggttccattgatataaacggcaaaacggataaaataccgctggcgtataagggcttgaagaacgacttcctcctgtcatatacatttacaagcggagggctgccgaccgttatcgtcacgcagcaggtattcgaccggatcgagaaagatatcgacccgtccatccagggaaaatcaaatcggtttttcggcattacactcaaacgagaagaggacatccaaaaagctgatggtctgtttcaggcgcagcactattcagacggtgcgctttcacaatttgaaacggctgacacgcaaaagaaaaacatggggctgatcatgtttattgtcgggtttttaggattaacctttctgatcacctcaggctgtatcctttattttaaacaaatgggcgagtgtgaggatgagaaggctgattatacgatattgcggaagctcggcttcacaacgggagatctgctgaaaggcatccgccggaagcaggcgtatcatttcggcattccgctcgttctcgggctgttccacagctattttgccgttcagtcaggatggtttttattcggaacggaagtgtggacgccgatgatcatcgtcatggcgctgtatacgctgctgtactccatcttcggcatgctgtcggtgctgtattataaaaaggtcattcaatccgccttgtaaaacaagttgaggagcctccgcataagcggaggctttttttgtatgaatagaagaaagcgatttttaaaagaatagacatacgtcattttttcgcgcgggggagccttatgcagaagtattttcaattgaaatctgaaacaggggcctttcatcttttttccaaggaacacattttcacattgttgatcatcgggttgctgggggcgggcgtgatcgtattccggaaaaagctcaaccagagccgcatgatccgctatgtactattcattctccttgccgtgtcgcagatcagctatcatatatggctgctttgtcatcatgcctggtcgctgaaaacagctctgccgctgcagctgagcgacctttccgtctatttggcgatgctgatggtcatgacaaaaagcaaaaagctattcgccttcctctattttgccggtttgggcagcgccgtacaggcgatggcaacacctgatttaggggcgtattctttcccgcattttcggtacatcgtgtttttcgtctcccacggctgtgtttttcttacctgtctattcatggccgcttcagaaaggtacaggccgtcggcgcgcgggctgtgggtgtcggtgctgatcgtaaatctgtacggggcgtgtgtcttttttattgatcgtgtgctgaatgcaaattatctatatttaatgaaaaaaccgaagaccgcttcgcttctgaatgttttcggaccttggccgtggtatcttctatcaatggaagcggcggtgatattgagcttcttcattctgtatattccgttttggctgctgaggaaaagagcatgaagccgggctgtttttgcgaatccaatcatttgtaattttttcaacattccggcattatttttttcagattctgatgttgaaaaaagacgtccgcggcgatagaatgaatgtgctatgataacgtgatcgatacggagccgcggcttgcggtttccgttttttcatggggttttttatagagagagggggatcggtatgccgcgcgctttgaagatattaatcatcggaatgtttatcaatgtgacgggcgcatcttttttgtggccgctgaatacgatctatattcataatcatttagggaaatcgctgactgttgcggggattgttctgatgctgaattccggggccagtgtggcggggaatttatgcggcggatttttgtttgataaaatcggcggattcaaatccattatgctgggcattatgatcacattggcaagtcttctcggactcgttctgtttcaccaatggcccgtttatatttggctgctcatcattgtcggcttcggttccggtatcgtgtttccggccagttacgccatggcgggagcggtatggaaagaaggcgggcggagagcttttaatgcgatttatgtagctcagaacgcaggtgtcgccgtgggctcggcactcggcgggatggttgcggcgtactcgtttacgtacgtgtttttagccaatgctttgctgtatgtgctgtttttccttatcgtatttttcgggtttcgaaatatcaaaaccggaaatgcgagccaggtttctgttctggactacgagcctgtcagcagcagaacgaaatttacggcgcttctcatattgagcggcgggtatgttctcgggtggattgcctattcgcagtggtccacaaccgttgcgtcacatactcaaagcatcggtatgccgctttcattatacagtgtgctctggaccgtaaacggaatattaattgtcgccggacagcctctcataggagctgttctgaaaaaatggtcaggcgcgttaaaaacgcagatggtcatcggcttttgtatttttatcgtttcgttcggcgtgcttcttagcgccaagcaatttccgatgtacctcaccgcaatggtgattttaaccgtcggagaaatgcttgtctggcctgccgttcctaccattgccaatcagcttgcgcctaaggggaaagaagggttttaccaaggattcgtcaacagtgcggcgacgggcggcagaatgatcgggccgctccttggcggcgtgctggttgatcagtacggcatgagcgtgctgctgttgatcctgatggtgcttcttgttgtcagcatcgcagcgacggtgctgtacgacaaacgcctgaaaaccgttaataaacaaaacatccaagtgcgatgacgacataaaaaatcccgccgaaacagcgggatttttttgtttatacgaccggaagcacgttgacggcgtccttaacgtttaaatacgtctttaatgaagaaaagctggcatcaagctgattcattctcatggcgagggaaggcttgatcccggtgataatcagttctgtgccgattaatttaagcaggtggtgcaatttgaaaatctggtctgccgtctgttcgtttacctcggccaaacctgataagtctataattaagtaatcatctttagatgcggttaatatgtccgtcaaagttgtcacaattgaatcaaatcgttcttccgttaagtttcccactaacggcaaggcggagatgccgtttcggatcggaacaatcggtgttgacagcgtcgtgatttctgtgagggaatcctccaggagcttttcgtattctttctgctctgtaatgtctttttgaaaaccgacaaaatagagcttgtcttcaacatacagaggatcaatgttgagttcattccaaaacggggtgccgtcttttttgacatttttcagccgcaccgtgatcttttctttctggtttaagctctttcttattttcgcgacttgttgacggtcggtttctttgctttgcagaaatctgcagttcttacctaatatctcttcggaagcgtagcctgtcatatccataaatccctgatttgtatatatgatgggattgtcctcaagagaggggtctgtaatcaccacgccgatgcgtgcgtgatcaagcgcctttttgataagctccagctgctccagttttccggatacatttgagtcagccatgtaaaacccccttttggccgtaaagctgcgcgcttttttcagccgttgtttctcccctttttaaatgaatctacagtaaccgtagcataacatatgttctgattcaagcagccgaagtttgcaatttgtcattcgggcttgtcctcatatacactgaatatataaggggaaggcacatcatcgctaagtaagtgactaggtcattgtcactgggtgaaaaatgaatctaatgcatcaagcttaccgatcatgtgttcacatataatggaagaaacaagctttttactttcctgctcaatcgccggtatgtagatatcgaaaatcatcgtattcgtaagggggctggatggcctgaagtcgctttactaaataagggctttaggaaggtgatgaagatgctgcatcaggtaataattgcttgtgtaattggaggcatcatgggggttctcggtcatgtgaaaaagagaggcaggctggagaaacccagaatgacaaagcggtttatctatctcggttttttggaagatggttttatcggaatggctgcttccatcttacttgtcttatccgctgaccccgattcaggaattcaactcgtcatcttatccataatcgcaggctacggcggagaagctgttctcaggagctttgattttgtcagagaacaaaacagtgattcggccgaagcaaaaccacaccagcaaaaaaatcctccatcaaaataatatccccgctcacgacccgttccgggtacattcccattgtatacaaacctgcttgcacttatgaacagaattctataaaatacaggtaagattacggtagcgataagaacagtgaagaggagcagtaagaagcagatttcgcactcagagaattgacggccggtgcaagtcaatcaagtctgtttccgaactcgcctcagagttgcagcggcaaaaccgctgacgcataactgcgttaaaagtatcaagtgagtgcggcttaaaaccgcgctaacgagggtggtaccgcgggaaacaaaaatctctcgtcccttttagggatgagggagttttttttagttttagaataatctgaatataatcttcctcatcccgtcaatacttggactacatacgccgtattcaatcagaaggaggtttttacgttgagttttcagcacgaaaaaatagaaaagaaatggcagaattactggttggatcataaaacgttcgccgtcagtgaagagaatgacaagccgaagttttacgcgcttgacatgtttccgtatccttcaggagccggccttcatgtcggacatccggaaggctatacggcaaccgatatcctttctcgcatgagacgcatgcaagggtacaatgtgcttcatccgatgggatgggacgcgttcgggcttcctgccgagcaatacgcgcttgacacgggaaatgatccggctgagttcacaaaacaaaatatagataatttccgccgccagatccaatcactcggattttcttatgattgggatcgtgaaatcaatacgactgatccggactattacaagtggacgcagtggatcttcaccaagctgtacgaaaaagggctcgcatacgtagacgaagtgccggtcaactggtgcccggcgctcggaacggtgcttgcgaacgaagaagtcattgacggcaaaagcgagcggggcggccatccggttgaacgccgcccgatgagacaatggatgctgaaaatcaccgcttatgcggacaggcttcttgaagatttagaagaacttgactggccggaaagcattaaagacatgcaacgcaactggatcggacgctcagaaggcgcaaacgtgcatttcgcgatcgacggcactgatgacacgtttacggtgtttacgacaagaccggacacgctgttcggcgcggcttatgccgtactggctcctgagcatgagcttgtggaggccatcacgacgcctgaacaaaaagaagcggtagacgcttatgttaaagaagttcaggcgaaaagtgacctggaacggacggatcttgcgaaaacaaaaacgggcgtcttcacaggtgcatatgccgtaaaccctgcaaacggggaaaagctgccgatctggatagcggattatgtcctcgcctcttacggaacgggcgctgtaatggccgtgccggcgcatgacgaacgtgattttgaattcgccaaagtgttcagcctgcctgtcaaagaagtcgtaaaaggcggaaacacggaagaagaagcgtacacgggagacggagaacatgtcaattccggctttctgaacggactgaataaagcggaagcgattgaaaaaatgatcgcctggcttgaagaaacgaaaaacggtgagaagaaagtgacataccgtctgcgtgactggctgttcagccgccagcgctattggggcgagccgattccggtcattcattgggaagacggtacgtcaacagccgttccggcggaagagctgccgctgattctgccgaaaaccgatgagatcaaaccgagcggaacaggtgaatcaccgcttgccaacattaaagagtgggtggaagtcactgatcctgaaacgggtagaaaaggcagaagagaaacgaacacgatgccgcaatgggcgggaagctgctggtatttcctccgctttatcgacccgaaaaatccggatcagctcgcttcacctgagaaactggataaatggctgcccgttgatatttacatcggaggggcggagcatgccgtgcttcaccttctgtacgctcgtttctggcataaattcctctatgatatcggtgtcgtgccgacgaaagaaccgttccaaaagctgtataaccaagggatgattctcggggaaaacaatgaaaaaatgagtaaatcccgcggaaacgtcgtcaatccggatgaaattgtggcgtctcacggagcagatacgcttcgcctgtacgaaatgtttatggggccgcttgacgcatctatcgcctggtctgaatcaggccttgacggagcacgccgcttccttgaccgcgtatggcgtttgtttatcgaggaaaacggcgagctgacgggcaaagtgacagaaggcgcgggcgaaactcttgagcgcgtctatcatgaaacggtcatgaaagtgacagaaaacttcgaagcccttcgttttaacacgggcatttctcagctgatggtgttcattaatgaagcttacaaagcgaatgaactgccgagagaatatatcgaaggttttgtgaagctgctttctcctgttgcgccgcatttggcggaagaactgtgggaaaaactcggccacgaaggttcgattgcatacgaggcttggcctgcttatgacgaatcaaaactggtggacgatgaagtggaaatcgtcgtccagctgaacggaaaagtaaaagcgaaattaatggttccggctgatgctgataaagcagcgttagaacagctcgcacaagctgacgaaaaagtaaaagagcagcttgaaggaaaaacgatccgaaaaattattgccgtaccgggcaagcttgtcaatatcgtggcaaactgaccggacgaagcccctctcctacagagaggggcttttttatcaggcctctatcatagaaattgcaccgcgggctttggtatacttaacaccataaagatgaatgggagtgtcacacattgaaaataaatgaaatcagcacagccgcactggaagaaaaattaaaagcgggagaagagctgtatctgattgatgtcagagaagacgaagaagttgccgaaggaatgattccggaggccgttcatatccgcatgggggacatccctgagaagatggatgcgttagacaaggacaaggaatatgtatttatctgccgttccggaaaaagaagcatgaacgtttgtatgtatttacatgagcagggcttccgtacagttaatgttgaaggcggcatgctggagtgggaaggcgaaacaaagccgaagaaataacgctttgaagtgaaagaagaaaagggacgtgcgtctttttcttctttttttataaaaaaaacgggaggcgaatcaggtgaaaccgatgatccgcgcgatgaaaacaaacgatatcaaacaggtccggcaagtcgcagaacgcagctggcatcatacgtatgaagggattattcccagacacattcaggatcagtttctcgaatccgcctatcaggatgagatgatggaacgccggctcttgcattctttgttctttgtggcggaagaagaggggcgagtgctcggttttgcaaatgccaccccggttcaaaaagacggaaatgcggagctgaccgccatctatattgatccggattgccagggaagcgggataggcacggcacttcttaaagaatgcatcaggcagtccggcggggtaaaaaagctttatgtccatgcagaaaaagagaaccgcatcgccttgtccttttatcaagcgaaagggtttcaaagggtatgtgaatttgaagaagattttaaaggacacaccttacagacggtcaaactggtgctgaacatataaaaacgtccggcccgcccgggaccggatcgcgaatgatcagtgataagccggaagccggtctttgtgcgcttcaaataagtcatcgcacaaagagatgatgtcattcatggaaagctcggcgctcgtatgcggatcaagcatggccgcttgatatacggcttccttttttaatgtaacggccgcttcgatggttaaaagctgtgtgttgatgtttgttctgttgagcgccgcgagctgctccggaagttcgccggaatagcacggcataatttggtttttaacggcggcgcacggcacttcaacgaccgctttcgccggcagattcggtatcagcccggtattcagcacattgccgccgaatgtgaacggacggcccgtctccatcgcttctataattctcgaaccgtattctttcgagcgttcatgcgtcaggttttggttgttgatgatcccgtctctcatcgtttcccagtttttgatttgttccgcgcatctcctcggatattcatcaagcggaatttggagttcatctatcagctccggataccggctttttataaaatacgggtgatattcggcattatgctcagatgattccgtcacgtagcagccgaatttatccatcagctcaaaccgcaccatgtccttatgtttcgtcttttgtttttcgcgtgcccgtcttttaatttccggatataaatcaattccgtcttttttaatctccaaaagccaagccatatggttgatgccggcaatgcgttcttccgtaccttcgtgatccatgccgagtgagtcgaacagatctttggtacagacctggacgctgtggcacaggccgaccgttttgacatttgtatgtctgagcatcgctccggtcagagaggccatcggatttgtatagtttaacagccacgcatccgggcagacctcttccatgtcttttgcgatgtcaaataaaacggggatggtgcgaagggaacggaaaatgccgcctattccgacggtatcggcaatcgtctggcggagaccgtaccgcttcgggatgtcaaagtcaatgaccgtcgcgggtttatagcctccgacctgaatggcgtttatcacatagccggcgtgtgtaagcgcttgttttcggtcatcgtaggagatgatggatatactcggattgtagcggtctctcatgttttccagcatgagctgagattctttcagccgtacagcgtcaatatcataaagcgcgaattcaaatccgtttaatgcttcagtcagtaaacagtcccccagtacattttttgcgaaaatcgtgctccccgctccgataaacgtaattttcttcaacagaaattcctcccttttcttctcagcctttgaccgccccggaggacagccctgagataaaatatttttgaagtgccaaaaacaatacgaccatcggcagcatcgccataattgcggctgcggcgactaagtgaagattgttcgcgttttcgccgaagaaccccgccatggccacggtcaatgtctgcaccttttgatcttgtaaaaagaaaatcgcaaattggtaatcgttccagataaacacgcaggaaataatgcagaccgttgcggtaatcggtttcaacaaaggaaacacgattgtataaaaagtcctgatcaatcccgcgccgtccatcctggcggcttcctcaagttctttcggaatggaagagcggataaaccctgaatataagaaaacggtcagcggcatatatgcagccgtattaatgagaatggctgcggcatgcgtattgaccagccccgcatcagcgaccatcttgtataaaggaaccatggaagtcaaaggcgggataatcatgatggaaatcaaaaggccgaagacgattttgttcagctttgtatttcttctagcgagcgggtatgcggcaagcgaacccatgaaaattagcaaggcggcggaaacggctgtaataatgatcgtgttcagaaaggattgcccgagagaggcacgctcccatgcttcacgaaaattctgaaatgaaaaggcggatggcagcgaccattttgaactgtagtctccttttgcttttaatgacgtggtcagcaaaatataaaaggggacaaaatgaacgcacgagataacggcagccaacagcgtaaaaatccgcattcgggctgttttcatgacatttccgtctcctttcgcttgaaatacacgagagccgaaaagctgatgacaagaataataacggacataaacacgccttgggcggcggcatatcccgcatcctgccgtttaaaatataaatcatacataaacgtcgacatcgattgagaggaattgcccggcccgcctgcggtcagagcgaaaatgacatcaaacagcttcagcccgccgatgatattgatgaccatgttgatggtgacagccggcatcaataatggcagggtgatggtgaaaaacggctgaagacctcccgcgccatccatttttgcagcttcataataatctttcggaatgctttgcagccccgccaaatatacaatcatcgcaatgcctgcgtattgatacgtgttaatcatgacgataatccacgggtttgccgcagggcttgccaaggcgttgacaggaccgattcccagtgcgcccagtacatcattcagcgcacccccgtcatatgagaaaataaaataccaaatgtatcccataatcagcggactgataatgacgggcaggtagacgatcgttcttgtgagcgccttcatttttaagctctgattcaaaagcagcgcatataaaagtccgagcatattctgaaaaaaagtgcttccgatgccgtaaagcaaagtgtttttcacaataagccacgtgtccggatctgtaaaaagccttttatattgagtgacccccacccattgatacgtctgtgagaagccgttccagtttgtgaatgtgataaaagcgcctttgacaaacggaaaaatcatgaaaataaaaaccgtggcaagagcgggaacgtacatccaccacagtgacgcgggttttaccggcttttgatgctgaaatccttgggtttctcttgcaagatcactcattctttgtcagctccttgtgaatcagattgaagacggagccgcttatattccctgccgagtttcgccgaaacttccgcgggggttaagatatcggccgtcagctcctgcccggctgtccccatcacatcccacattccgttcggcaaataaaggcggtcaaaataaggctgcaccttaatatgctgatagcgcttatagtcatttgcgtagaaaatgtccgtttgcacattcactaatccggccggaagcgaggtcgcttcggcaattgatttcgcatgctcgggacgggccataaatgcgatgaactgtttcgcttcttcaagccgcggggaatccttgaatgccgccagcgtgtaacgttcgcctccgatccaaaccggcgcgtctcccttgtggacggccggggtcggtatgatgccgacttttaccttcggattgatttgagcgacgtcttggccgagggtgccgccctgcagcgtaaaggcgattttgttttgcgccatcagttcaatgagctgggaccgttttgccgtcacggcatctatattgagcaggctttccttttgcatctctttcagtttgtcagataaataggtgaagtgtgtccagcggaaggttccgtttaacagctgttttttgtaacggtgtgcgggatctgtgatgagaagcggtgcggcgaattgatcgtaatattgggcaaatgagcttttctcatagccggcaaaccagaagggggtgactgttccgccgcttttttctttaatctgtctcagtgccttcataaaatcatccattgtttccggcggtttgattctgtatttttccaacattgtgcggttgtaggccagtccgtcctttgcctgattcagagggaaggcgtatattctgcctttggcgtctttgagcatgctgtttaaattcggatcgagccgcttcgtccaagacatgccgctgaggtcggcggtatattctccgtagcggattttagcccagccgtgtgtgtcgaaaagatcgggcatgtcaccggctgccattctgaccctcatcatattttcgtagtcattgcctgggaaatgaacgtttacttgaatgtccggatgttctttttggaatgaatcagccaactttctgaatacggcgcgttcgctgtctgaggatattgtggaatagactgtcaatgttttctgcttttctccggcgccgctctgttctgccgagcagccgggtagtatcatgcaagtaaaagaaagaaacaaagccagtaagcgtttcatcttttcctcctttaaatatgatataaacgctgcgggacatgtcacctcctttcttgtgagccgcagctttgtctgacaatcaatgaagtggggagcgtcacggccagcgggacggttctgccgtttaaacggtcgagaagcaatttgacacccgtccggcccatctcttccgtgtatacttttaccgttgataacggcgtgctggcgtattctgcctcatcaattccgttgaagctgacaattgccgtatcgcgcgggacttgaaggccggcttcctgcaaggcttttaaagcgccgacagccatcgaatcacttgcgataaaaaaggcatcggggagacttccgcctttgatggcttcattcatcagccggaacccttcgtgcatgctgtattcgccgatcagtacatgctccggcccggctccggccatttgtaagaaagcggtcagacgcttatcctcaatcgttttattgctgtttacaccgtctatgacggtatgctcccgttcccggccgccgatataaccgagccgctggtaaccgagcgacagaagatgttcgatcgccttttgcgctgcggcataaaaatccacgctgacagaatcgtagcgggcgggatcgggggtgccgttaacaaataccgcgtgcctgaaagcggcgctgatattcgtaagcgcctcgtcttgcaggctgccgattacgatcacgccgtccagatcgtgaaacatatgctcttgaaaagacccgagatggatagaagatgtgataaaaactttttgccgaaagcattcttcctcaatgccttttcggatcgctgaaaaataaggatcctgccgttcttcttccggtgacaggcagctgacaacgccgatcaggggggctgaatcgctgcggctgcggttcttccgtttttttgccgacggctgatagcccagctcatcggcgatcctcagaactttttctcttgtttcatcagtcacggccaaagagtcatccttattcaaaattctcgatactgtcgcgctggatacagatgcctgtaaggcaatatctttgagacggaccatttcgtatctcctttttactaaatatttactaaacagaaatgacctggttattgttaaaatgatattatcatatattagtaagcgttttcaataactatttttggttacttttagtaaaaatcagtaaaaaagaaaatctgtttttctctatcatatttcaattgaaccggaataaattgatagagaaaggagagggtgatgtgctgaagatagctgtttttgatgaggagcatgaaaaggatctgcagactgaagtcaatacatttttaaaggggatttctgatgaacagctcgttgatattaaatatacggtagcggcggcctgtgatcctgaaggtgagcagctttattgtttttccgctctcattttataccgaaaataaaaaagcccggatgaaataccgggcttttttatgcattatgcttttttgacgcggggacttctcggtttttggtatttctccgcttgtttgattccttttctttcgctcgctaatgacttgtacagagacacgatcatcagaaggatcacgactgaaaacggaaccgcggcgagaatggccgtgttttgcagtgcggccagaccgccggaatataataatacagctgccacggcggactggatgacgccccagatgattttcacccggtttgacgggtccaaagagccgtaagacgtttgcattccaagcacaaatgtcgctgaatccgctgatgtaataaagaatacagcaatcagaataagcgttaatacggatgtcaccattgtcagcggatagtggctgagtgcgccgaacagcatcgtatccgttgacattcccgcgacattgaatacgcctttctgctgaagatccatcgcggatacaccgaaaatcgcaaaccataagaaagccaatatacaaggtgtcaccaacaccccgattaaaaattcccggatcgtccggccccttgatacacgggcgataaaaatgccgacaaacggcgaccaggatatccaccaggcccaatagaaaatggtccagctgttaatccattcgcgtttttggggatcattcggagacaagcgaaagctcatctgcacgatattttggatgtattggccgatagaatcggtaaatgagttcataatcagcactgtcgggcctgcaatgagcataaagatcattaaaatacccgcgagcgccatgttggtattgcttaagtatttaatccctttgccgattccgctccacgcagaaatcaaaaataacacggtcacgacagcgatcaggatcagctgaatggaaaatgttttcggaatgccgaataaataatgcagaccgccgttgatctgagtcgctccgagccctaagcttgtcgccacaccgacaacggtcgcaaacaccgcgatacagtcaattgctttgccgatcgggccgtttactttatcgcccaaaagcggtgtcagagtgctgctgatcaaaccgggcgcgtcttttctgaattgaaaataagcgatacataaagcgacgaccgcatagatggcccaagcgtgcagtccccagtggaaaaacgtgtaccggagcgcatcacgaaatgcttggggtgtttctgtttcacctgagggagagctgatggcgtaatggctgatcggttccgcagccccgtaaaataccaaaccgattcccatgcccgcgctgaaaagcatggcaaaccatgataataagccgaattccggtttttccccgggttttccgagttttattgtgccgatcggactcacaatgagaaagagacagaaaccgacaaatatagaaacgaccagcagataataccagccgaaagaatccgtaataaatttttgtgccgtatcagtgacttgctgcaggctgtcaggagaaatggccccccataaaaccgcagctgctgtgatgacaatcacaatccaaaaaacactggagatgttcttcttcaaacgttctcaccctctgactatttttttcaatacgccattttttagtatggtcgcacgattgcagatcattcctttcttcctgttccctcaatcaggtgaaacaaaacgcagaaaactgtatcatgtttttggtcaattatcaacggggacgctcaggtaaatgcgctttaaaccatttacagcgagcgtgagaaacgtcctgcattcaaaccggcgagacgccccgtgacaaaggctgaagtgatattgtagcccccggtataaccgtgaatgtcgagtatttctccgcaaaaatataagccttccatttttttagacgccatttgtttcggctcaatctcttttacggaaacacctccgcctgtgacaaacgctttgtccaaagaaagcgttccgtcagcggcaaccgtaaattgtttgcagtctttgacaaaagccctgaattgatccttcggcagttccgtaaagcttgtctgcggatcaagaccgttccgttccagaagaaaaagcagataccgttcctgcatccacggcttcagtgcgtttttgagcgcttttttcggtgcgtctttcagttccttgtgcatcttttgaaataactcttcctcgttgatgccgggaaacagatcgatgcgtaatttgacatcgggctgctttttcagttctttgacgacaaactggctgcagcggagaatggcggggcctgacaagccgaaatgggtaaacagcatgtccatcacgtgtgtgacaataggtttgccttttttattcaggacgctgacggccgcgtttctaagggacagcccctgaagtgttttttgtttaataaacggttctgacgacgtaaccggcacttccgtcggaaagagttcggtcacggtatgaccggccgcttccgcccatgcatagccgtctccggtgctgccggtatgcgggactgattttccgccgaccgcgataatgacggcgtctgcgttaatgtgttcgtcattgtttgtcgtaatgcccgctgtcctgccgttctcgtaccgcacctctttgattttttcatttgtgcggatggtgacattcagttgttttaatcggttcaaaagcgcatcgacaacgctttgggctttgtccgtcaccgggaacatgcgcccgtggtcttcttctttcagctgaatgccgagtttttcaaaaaaggcgatgatatcttcattattaaattcggaaaacgcgctgtataaaaagcggccgttgccggggatgtgtttaatgatttcttcaacggggaggcggttggtcacgttgcagcgcccgccgccggaaatcgccagcttccgtcccagcttgtttcctttatcgattaataatacgtccgccccttcttcgcctgccgcaatcgcagccattaaaccggacgggccgccgccgatcacaattacgtcataatgtttcatatttcatcaacaactttctttttcacgtataataggcggaaatgtccgcttcctgctattatagcgaaagaaggggattccttaaacgtattttgtttttaagagctttcccaaaaagtttcccgctgtaattattaccgtctaattgcccagttgtgttaaaatagaaaagttgaatcttcgtagaaaatggtgatgaggaaacatgtcaagcaaattgttaaggggcacgttcgtgctgacgctcggcacctatatatcgcggattttagggatgatttatctgatcccgttcggagcgatggtcggagcgacgggcggagctttgtttcaatacggatataatcaatatacactgtttttaaacattgccacgatgggatttcccgccgcggtttcaaaatttgtctcgaaatataactccaaaggagactatgagacgagcaggcggatgctgagagcgggaatgtcggttatgctcgtaaccgggatgatcgctttttcaattctttatatttcggcgccgttttttgcggaaacatctctcggcggcacgagtaacaacggacttacgattgaccacgtcgtttatgtcatccggatggtcagtctggcacttttggtcgtgccgattatgagccttgtgcgcggttttttccaaggtcatcagatgatggggcccacagccgtttcacaggttgtggagcagcttgcccggatcatctttttattgggcgcaacgtatttgattttaagagtgatcaacggcggccttgtcatcgcagtcggatacgcgactttcgcggcgctgatcggatcattcggagggcttgtcgtcctttatatttactggaataagcggaagggcgatcttctggcgatgaagccgaatctcgtcccgtctgcgaacttaagttataaaaaaatgttcattgagcttttcagttatgccgctccttacgtatttgtcggactggcgattcctttgtattcatatatcgatacgaatacgtttaataaagcgatgattgcggcgggccataaggatatcagccaggacatgcttgcgattgtcaccctttatgtgccgaagcttgtgatgatcccggtttctctggcgaccgctttcggtctgacgctgattccgacgattactgaatcgtttacgagcaggaattataagcttttgaatcagcagattaaccagacgatgcaaattattctgtttttggttattcccgccgttgtcgggatgtccgtgttatcgggtccggcctatacgttcttctacggctctgaaagtcttcgcccggatatcggacaggatatattgttctggtacgcgcctgtcgcgattctgttttctctgtttaccgtaaacgccgcgatcctgcaagggattaataagcagaaatttgctgtcgtgagccttttcatcggcgtcattataaaagtggtgctgaacgtgccgctgatcaagctgtttcagggagacggggccatcttggcaacggcgctcggttatatcgcttctcttctgtacggttttatcatgattaagcgccatgcgggctattcgtatacggtacttataaaacgggtcattttaatcgcagtcctgtccgtcgtgatgggagtcgcggtcaagctgactcaatggctgctcagtttctttgtaacataccaaagcggccaggtgcatgcggcgattgtcgtctttgtctgcgccgctgtcggcggtgcggtgtacatgtttgccgcgtaccgaatcggatttttacagaaaatgtttggaaaccgtctgccccgcgttttgaggagaggcaggcattccgcccattgagaaataatgaatagtccgcttatcgcgggcttttctttttaaaggagaggatcaggatgagacttgataagctgcttgccaacagcggattcggctcaagaaaagatgtgaaaaaaatcgtcaaggccggggctgtcatgattgacggagagccggcgaaagatgtgaaaacccatgtcgatccggaaaaacaggacatcacggtatacggagagccggcagactatcgtgaatttatttatgtcatgatgaataagccgcaaggagtgctgtccgctacagaagacagccgccagcaaacggtggttgatctgctgacgcctgaagaacagcgatttgaaccgtttccggcgggacgtcttgataaggatacggaaggctttttgcttctcaccaatgacgggcagctcgctcatcgcctgctttctccgaaaaagcatgtgcctaaaacatatgaggtccggttaacttcacctctggcatcggaagacatcgttcatctggaaagaggcgtcgtcattgaaggaggctataagacgaagccggcagccgttgaaatcattacagaaaacccggatgaaacggtgattcacttgaccattacagaaggcaaatatcatcaggtgaagctgatggcaaaggctgtcggaaatgaagtggcttatttgaagcggctttcgatgggggctgtttctcttgacccggatcttaaaccgggagaattccgcgagctgactgaagaggagctcgaaacgctgagaggcgctgaagtgtaatcgatatcagaaaagcccaaaacagatttgttttgggctttttatatagaggaacaaaaaacaaggcaaagacgctgctttgccttgcagcatgtcaggccgaaaagggccttatgtaattgttcgcttaagatgtaattttcactttttttcgtgttgtctcccacttgcctcggctaggactatgaacaagatcattgtatgctaacacatttaagtctcgctgaatggttctaggtgtaatgccgaattcatcaaccagttcctgtgttgtcacaaggcctttttcctggatgaacatgtaaactgatttaatccgagtcagcatacgatttgttgaaggtttcaaaaaaccactccctatcataagatcggatggacttgatataccacaactttcgactctaaaacttcgtacgaataagcaacaaaggatgacattctgttttttttctcttttaactgcctccattatacacgatatggacgacatgaatctaggaataagcgcagataattttttccaaatgggtgcagccttggtgcattactatgtccggaccgcttttaatattatggaaactgaaactttttttatacatgtccgtatgaaagcgggggagtgagaagtttgggagaattattgaatgcaaacattgtctgcgccggttatgctgacaggccgaaggtgatttccgatgtatctctgtcagtcaacgctggtgaaattgccggtttaatcggagcgaacggcgcggggaaaagtacagtgataaaggcggttctcgggctgtcccgggatattgaaggcggtattgagtggaatgattcatcttatgcttacataccggagcggccgagtttttacgatgaactgacgctttgggagcacctcgagctgaccgggtcattgcggggtatagaaggggaagagtgccgtgagcgggcagggcggctgcttgaagagttttcgctgacgtctgtaaaacatgatttgccttccggtttttcaaaagggatgcagcaaaagatgatgcttatacaggcatttttggcgaagccggatatttacatcattgatgagccttttatcggacttgatccgatctcaacgaagctgtttaccgacatgctgattgctgagaaagaaaggggcgcgggaattttgatgtgcacgcatgttctggatacggcggaaaaaatctgcgaccggttttatttgctggatcagggcgctctgcttcttcaaggcacgttagaggagcttcaggaaaaaacggggagccgttcactgctggattgcttttattcagcggttcggagcagtcagcgatgaccgggcgggctttgttttttcaaaggctgtttcattattggcggtatcaatggaaggtgtttcagacggtcattgattggacggtcgcgctgtacatcgttcttcccgctgccgcatttgccgtttatcaatatgctgaatggctgaacggcagggggcttcttaatggagcggcaggagtattaggatggggctggctgtatgtattcagtgccttgctgttgtgcacgggttttattcatacctttttgctggaagcggatcacgtgtttttggtgcatgcaaaacatctgatgcaaaagctgaaacggtacgcgcttttgtattcgatgttcctttcccttatcaaatggggtgcgcttgccgtattgttatttcccttatggcgccagtacggtgactgtaccttaccggcatattcaggtatgttttgctgtctgttcggcttccataccgcgatattagcggtgcaccggcacagaaaaaacagcaggcggacattcgggaatcaggcggcgggctggctgaaagtgatggttctgacggcgggtgcgttttttatgatcacctttgccgccgaatggtattggctttggccggcgggatgtatattgttcatctgttccgcttttttgacttggaaagggacggagacattatcagcctttgaggaagaagtgcttgaggagaacaggcggaagctttcactcgccgcctcagttttgatgctcagccatgatgtgcagctcccgaatggtaaaaataaagggcggagcaagccgtttttatatcccggctcaaagcacatctttacaaaacggtcggcgtatacggcgtggaaagaattgttttttaaagtgctgatccgaaacggcgggtatctccggcagctttaccttttaaccgcggcttttacggctcttattctcgttcttccgctcttagtgaagccggcagtccttattttatttgcgatcgtcagccgctatgccgcgtcacttttatttgaccggatcacggataaaccggttttaagcggtatcaagagagacagtgatgactatttccgggcgcgaaacagtgcattaaccgtcattcaaatcatctgttccgcctggtgtctcattgccgcgattctttccgttctttatatgtaaaaatccctttccgaaaaggaaagggatttttcttaatgtccgttcaaaataaaaagctgaataaaaaacagcacggcgaagatgaggactagaggatggatttcgcgccattttttcttagctgctttaacaagcggatatgaaatgaagccgagtgcgattccggttgaaatactggacgttaaaggcatcgccaaaatgacgagaaaggccgggaacgcttcgtcaagctcattccagcggatattcgacacagcacccatcatcaggctgccgacaataatcagagccggtgacgtaatcgcggacacttccgataagacgctgacaagcgggctgaaaaacatggaaacggcaaacataacggcaatcgtcagcgccgtcagacctgttcttccgccggcggccacacctgctgaagattcaacgaacgcggtcgtcgggctggtgccgaagatgcttcccaccgtcgtagccgttgaatcagccaacagcgctcttctggcattcggcagctgattgtttttgatcaatcccgcttgttcagcgacaccgatcatggtgccggtcgtgtcaaaaatcgtaacgagaagaaaagaaaacacaacggcgtacagaccgtgatgcacgacatccccgagggcaccgaacggatttgtgattaaaagcccctccggcaggcgcggaaatgaaatgaaccctttcgcaaaatggatctgtccggtcaaaaaggcaatgacggcggtcagcgccattccgatgaacagagcgccgtttacattcagcaccatcagcacgatactgatgataagtccgataagcgttaaaatgacggcgggcgaatgaagatcgccgagtgcgaccagattggatttatcagccgtgatgattccggattggcgtaagccgataaaagcgataaataagccgatgccggtcgtaattccgtattttaaattgtccggaatcgcttctataagttgttttcttaaaggcgttaacgataaaataataaagatgactcccgcgataaaaacggcgctgaaagccgtctgatacgtaatgccgctgcctgtgccgacaacgtgaaaggcgagatacgcgtttaagcccatgccgggggcaatggcgatcggaaaattcgcagcgagagccatccataaagttccgacaatggaagcgataatcgtcgcggtgaacacctggtcaaacggaattcccgcattggaaaggatcaccggattgacgacaatgatatacaccattgtgaaaaaggtggtcaatcccgcggtaatttctctttttattgtcgtttgatgcttgtcgagatgaaacataagtacctccaatgacgaacattttttcaaaacatcatctatattattcgttttatcgacattttgcaagtctttatcaagaaaggggatttgtgatgaactgggaagttgaagtcatcagaaacaaagaagatctgatccgtgacacgcagaagtttttgcagatcaacagcgtaatggacgaatcaacagccggtcccggccggccgtttggagaaggcgtcaatgccagcctggcgtcactgctggaattcggtaaaaaagaaggcttcaccgtaaagaatcttgacggctatgcgggccatattgaatggggaacgggtgacgaaatcgtcggtgttttgtgccacgtcgatgtcgttccgcccggagacggctggacgagcgatccgttttcagccgatatcagggacggccggatatatgccagaggcgccattgatgataaagggccgacaatggcggcgttttatgcgctgaaaatcgtcaaagacatgcagcttcctttatccaaacgcgtgagaatcatcatcggaacggatgaagaaagtgattggagatgcgtggatcactacttcaaacacgaaaaaatgcctgacatcggctttgctcctgacgcagattttccgatcattaacgcggaaaaaggaattatagatgcgtcactgcgcattgtaaaaaacgcttctgacaaagacgcaaaaaacgtgcttctgtcattccgttcaggactgcgcttgaacatggtgccggatgcggctgaagcggttattgaagggaacggtattgatgccgtgcacgcatatttcagcaaatggcttgagcagtcaaaaacacaaggtgaagcagtttcggaaaatggaaaactgacgcttcgggtatacgggaaatcatgccacgcgatggaaccggataatggtatcaatgccggcttaaagcttgctgaatgccttaacggaacagagctggatggagccggaaagcactttgtcaaaaccgtcagtgactattttttaaatgatacacgaggcaaaaagctgaaaattgattgcagggatgacatcagcggagagcttacattgaatgtcggcacctttacatacagaaagggtgaggatggagaactcggcatcaacatccgttatcccgtcacttcagacagcaaagtcatccgtgatgcttttacgtctgctgaagaattccggcttgaagaatttaaagacagcaaaccgcaccacgtttctgccgatcatccgctcgtaaagacgcttcaaaaggtttacgaaggacagacgggaaagaaagcggatctgatttcaatcggcggaggaacgtatgcgagatccctttcggcgggcgtcgcgttcggtccgctgttccccggccggcctgacagcgcgcatcaaaaggatgagtacattgaaatcgatgaccttctcaggtcaacggctttatatgccgaagccatttatgaacttgccaagtgataataaaaagggacgccgaaagcggcatccctttttatcattcaaatgaccataaatccgtggataaataacgttctcccgtatcggccgtcatacagatgacgatctgttcgggagggaggcgtttggcggtttcaatggcggcgaagcaggcggcgcctgaagacgggccgacgagtatgccttcttcccgggccagacgacgtgttgtcgtatacgcatcttcatcagatattttcatgatttcatcgtaaacgtcctgattcagtatgccgggaataaatccggggcttgtcccgacaagcttatgagcgccgggttttccgccagacaggacgggagatcccgcaggctcggcgacatgaacaatcatatccgggaaaagctctttcagcgtttctccggttccggtaatggtcccgcccgttcccgccgttgccacaaaagcaccgagcggtctgttgagctgctgaacggcctgatagatttcaatggcggtcgtttttcggtgggcatctggatttgcgccgttatcgaattgcatcgggataaaacttcccggaatctgttcggcgagttctttcgcttttttgatgctgccgggcattctttccgcccccggtgttaacacaacctccgcgccgtacgctttcaggaggttgatgcgttctttcgtcatcgtgtcaggcatgacgaggattgccttgtagccgcgcgccgccgcgttcatcgccaggccgatgcctgtgttgccgcttgtcggttcgatgatgacagagccgggttttaaatgcccgctgttttccgcttcaatgatcatattgtaagccgctctgtctttgacactgccgctcgggttaaacgattctaattttaaatagacctgtgctgcatgttctggctgaaggcgattgagctttacgatcggtgtgccgccgatcagctccgccgtgctgtttacgattttcaaggccggctcattcctttctgtataaaacgttcggtacataatatcctatcataatgagcggacagggttctcctctccgcttatccgttttataataacaccataaccaaagagggggagatcctcgtatgaaagcttcattgccgcattattttatcggcattccgattccggctgacattgctgaaccgatttgggaagcagccaaaaaggagccggcgttatcattcaaaaaatgggtgcacccgcatgactatcatattacgctcatttttctcggagccgcggatgaagaacggcttgcgaaattatcgtctctgctcgcagatgctgcgtcggcagcgcagccgtttaccgtacagtttcagcatctggatattttcggcgaccgcagacagccgagagtgcttcaccttgagcccgaacggaatgaactgctctttgatttgcgggaaaaaacaaaacaggctgttttgaaagccggttttcaagtggaaaaacggccgtatcaccctcatatgacgatggcgcggaagtgggcgggagaccggccgttttctgacgatgtgccgtttgaaagcggcagggtgcaaagtgccgtcagcaggttttccctgtttcagacccatcttgaccggtcgcctaaatacgaagaaatcgcacagtttcaattgacataaacaaatattcggagtggagaaatcacatggcacagatcatcaaaattcacgactgcatatccagatatgaacttgatccataccattatatgaaccagtttatccggctgaagaaagaacgctgggaggcgcttcttgaagcgtttgaccggataacggaagaaacggaaacggctgccggcggggaaaccgatcaagcgccggccaggaaaaaattttccttaaaaaagagaaaagaagaaaatacggccgatataaatgaaaagaggcaccaatggtttgatgaaccggagggagaagaggcgctgttcgggaatcttccgtctcaaaagtctgagctcgcgccttttttcaaagatcagctgtatgactttcaattaaaatgggcgagctccacgctttctcaaaagtctgagctttcgcaggcggtcaaaagggacaggatgttaaaaatgctggctcaaaaactgcccgattcctattttgtgatgtatcatccggttctgcaaattcagcaggcgtccgtcgaactgagcattatcatcatctcgccgctggagattttctgcgccgcttttatggaagcggaagaggacagtgtatatatcggatcaaaacaccgtttttgggaagaaagaggctccggcagcacgcgccaagtattgaatccgtctctcagcctgcaccggacgggctcggtcgtttcgcaaatcgtaaaagaaaagcaggccgacattcccgtgcggaagcttttgctcagcagaacgtcttatattgattacccggagccgccgtacgggctggaaatagctgataaacggactgcggcagggtggctggaaaagcagcagaaaaatacggcgccgatcaagcaccaccagctgaaggcggcgaaggctcttttgtcttacggcttgagcgattcaagccggagacaggaatggcttgattaaagcggacgtttgccggctgtctcttcatctatgaagcaggtgaaaacaaacgatgagtcaatggttttttattattaatccggtctcaggaggcgggcggggccggcgtgtctggaaatcagttcaaaaagagctgaccaggcgcggggtcagccaccgctcttttttgaccgggcatcccggacatgcggaggtgctggcaagacagatttcaatgatgcaggatcataagcttaagcggctgttcgtcatcggcggtgacgggacgatgcatgaagtcattaacggactgaaaggaacggatcagattgagctgacctttgtgcccgccggttcgtacaatgacttttccaaagggctcggtattaagaagtcggcgctcctccaagaaatcaaaagtctgcaccgcccgctcacacggaaattttttgcgggaaacatcaacttttttcatgacaaagcgcaatcactctattttattaaccacctgtctgtcggcttcgatgcctcagttttgaaggcagccgcgaattttccgttttcgcgcgttcttcggtttttgcgtctcggctttgtgatttacccgctcgcgcatttacatacggcctcggggtttcagccgttcagatttgtttgcacggcagacggccagagacgtgaattccgcaatgtctggtttgttattgcggctaatcacccttattacggaggcggcatgaaagcggcgccttcagcaaatccccgtcaaaactattttgatattgtcattgcagaaaacctgtcctttttttcgctgtatcgttttttatgggcgatgagcttcggccggcatatcaaaatggacggagtgacgatgataaaggggaaggaattcgtttttgaaacagatgggaaaattccgtttcacgctgacggcgagctgatcggaacgacgccgtttcggcttatgccgggcggtgcgccattgaaaataaaaacataataaacaaatgaaacccgtcaattgtttcacggcaacagagcggttcgcggcataaatcttcagaattcacaggtgttcttgctagttttgcttgacgaagtttgtgctgtagcgctaaaatttataggacggctattgattagcatatgagactctcaatagctgtcttttttattctcatgaaattgtttatgacaggccgctccgccaatagagaaaggctggaggcctattctaaaatattttaagaaatgatgggttgaacattgatatgaactggttgggacaattactaggtagcgattgggagatcttccccgccggaggagctacaggagatgcatattatgcgaaacataacggccaacagctttttttaaaacgtaatagctcgccctttttagccgtgttatccgccgaaggcattgttccgaagctggtttggacaaaacggatggaaaacggagacgtcattacggctcagcattggatggcgggcagggagctgaaggcaaaggatatgagcggacgcccggtggctgagctgctccgcaaaatccacacatcaaaagctttgctcgacatgctgaaaagattgggaaaagaaccgcttgatccgggcgcccttttgtcgcagctgaagcaggccgtctttgccgtgcggcaattttcgccgcttattcaggaaggccttgcttatttggaagctcatgtggatcaggtgcaattcggtgaaaaagtcgtttgccattgtgatgtgaatcataataactggcttctgtctgaagacaaccagctgtatttaatagattgggacggcgccatgatagccgatccggccatggatctcggccctttattgtatcattacgtcgaagagccagcgtgggacagctggcttgggatgtacggcatgaagctcacggaagggcttcggctgcggatggcgtggtacatgttatcggagaccatcaccttcatcgcctggcacaaatcaaaaggaaacgacaaagcgtatcatgatgccatggaagagcttcatgccctgatgaagcggattgtcaagtagtcaggagtacgaatccatctgctccacccattgggacaaatggttttggtgctcctgaatatgcgtgtcgatggaatcggccgtgatgccggactggctgtagcggtagacatcctcgagcacgttttttatatttgaatcaagcccggtgttggccatcagtgatttgatgacgcgctccagctgttcatactcggcaaccgtgccgcagcaatccaattgatggtcggccaatatgtcctttaataaccggacctgatgttcgcttgttaagcccatgattcatatacacatcctttctgtgtcatacattgtgcaaagcggtgcggttttatgcatcacatgagtgttccggaccggggagcctctttttttatgcggccggcgcctttaaaaggcgcttgcggctctttatgtttcatggtatgttgttactcgaaattatagatagaggtgtcaatcatatgagaatgcgccataaaccttgggcgaatgattttctggcagaaaacgctgacatcgccatcagtgatccggcccagtataaagggcggtggaatacggtctttggcaatgacaacccgatccatattgaagtcggtacgggaaaagggcagttcatttcaggaatggccaagcagaatccggatatcaactatatcggaattgagctgtttaaaagcgtcatcgtcactgccgtccaaaaagtaaaggacagcggggctcataatgtccgtttgttaaatatagacgcggaaacactgaatgacgtatttgaacggggagaaatcaagcgcgtttatttaaacttttctgacccgtggccgaaaaaccgtcacgaaaagcgccgtttaacatttaaaacgttcttgaaaaaatacgaagaagtgatgggcgaaacaggtgagattcatttcaaaaccgataaccgcggtttattcgaatactctctgaaaagcttttccgaatacggcctgcttctgacagaagtcagcctagatctgcacaacagcgatccgaagggcaatattatgacagaatacgaagaaaaattctccgcactcggccagccgatttaccgggccgaagttgaatggagaacaaaagacagactctgatgcgggagtctgtttttttatgccgccatttgctaccattatatcaggagggatcaagatggagacattgaatattgggaatatttcattaacatggctggacggcggtgtaacacatatggacggcggagcgatgttcggcgttgtcccgaagcctttatggtcgagaaaataccccgtaaatgacaaaaaccagattgaattaagaacagacccgattctgatcagaacaaacggcctgaatatattggttgacgcgggtatcggcagagggaaattttctgataaacaaaaaaggaattacggtgtaacacaggaatccaatttaaaacactctcttcgtgaactcgggctttcctgtgaggacattcatattgcggcgatgacccatcttcattttgaccatgcatgcggcttgacggaatacagcggagaggagcttgtctctgttttcccgaatgcccgcattatcacttctgcaacagagtggcgcgaaatgagaaaccctaatatcagatcgaaaaatacatattggagagaaaattgggaggcggtacaagatcaggtcgaaacctttgagaacgagtatcagctgacagaaggcattacgatgcaccacaccggaggccacagcgacggccacagtgtcatcgtcttagaagacggcggggagacggctgtgcattttgccgacctgatgccgacgaatgcgcataaaaatccgttatgggtgctggcctatgatgattatccgatgacctccattccgcaaaagcagaaatggcagacgttcgcggcagaaaaaggcgcctggctgattttctatcacgacgcgatttacagagcggtaaaatggggagaagacggcgaagtggctgcatctgtcaaacgggagagaaaataagcggatcgatgatttacctgtatgaatttcgggaataaaagcaaacctaagacaaattgctttgaaaggaagagacaggtgaatcaatttcaagtgacgaaagatggagaaatcaaaacaactctgcgcggattagaagtgctttctacgccttttttaaataaaggggtggcctttacacaggaggaaagaaaggaactcgggctcgagggatttctgccgccgaaagtattgacaatcgaagagcaggcgaggcgggcctacgaacaattcagttcgcagcctgatgagctgagcaaaaatgtgtacttgaccgctctccatgatcggaatgaaacattattttacaggctgttaaatgatcatttaggcgaaatgctgccgatcgtatatacgccgaccgtcggcaccgcgatccagcgttacagccacgagtacagaaaaccccgcggtctgtatttgtcaatagatgaccctgaaggaatgcgcgccgcatttcagcagttcggaaaaaatgaaaacattgacttgatcgttgcgacagatgcggagggcattctgggaatcggtgactggggcgtcggcggcatcgccatttctgtcggaaaactcgcggtgtatacggcggccgccggaattgatccgtcacgagtgcttgcggtcgttttggacgcggggacaaatcaagaaagcctcttaaatgacccgctgtatgtcggaaaccaacattcaagagtgcgcggcgagaaatatgaccgctttattgatgagtatgtctcgcttgcccgggaaacattcccgaatgcgctgcttcattgggaggatttcggcacggctaacgcccgcggcatattaaaacggtataaagataaagtctgtacgtttaacgatgacattcaaggaacaggcgcggtgtcgcttgcagctgttttagcgtgtgcgaaagcatcaaaagtgcctttaaaagagcataaagtcgtcgtcttcggcgcgggaacggccggtatcggaattgctgagcagctgcgcgaagctatggtgcataacggattaagcgaagaagaatcatacagccgcttttggtgtatcgacagaaacggattgttgacggatgatatgaaggacttgcgtgattttcaggttccgtacgcccgccctgctgatgaagtgaaagagtacggccgcagcggtgaaggcggatcaattgatctggcggagacggtgcgacaggccaagccgacgatcctgatcggcacatctaccgtttcaggcgcatttacggaagaaatcgtcaaagaaatggcctcacatgtcaaacggccggctattttgcctatgtcaaacccgacgacattatcagaagcaaaacctgaagatttaattaaatggacggaaggccgcgcgcttgtcacaacgggaagtccgttcccgcctgttgcgtataacggcgttacctaccatatcggacaggcgaacaacgcgctcgtattcccgggactcgggctcggaacgattgtgacaaaagcaaggctcattacggacaatatgttcgttgcctgcgcgaatgccatcgccggtatggtggacgtcggcaagccgggcgcgccgatgcttccgaaagtggaggatctcaggacggtatcggcaaccgtggcggtagctgtagctaaagctgcgattcaggacggtgtagcggaaacggaacccgaggatctgatccaagcggttcaggacgcgatgtggaaccccgtatataaacgaattcggccgatgtaaccgaataaagcccaaaacgctgatggttttgggctttattttttgcttgtccgaattatgaggcgacagaatcaatgacatcgacaatctggcctgtttttgcattgaccataacttcatattgctccagttcgccgaatgccgaacgtgtcacgccggttttgtatacctggatggtttctccgtttacctggtagggctccggctctgtgtaaatccatgatccgtctatcggcccgcgctgtttaaaagccgctttcacgatacggagcgctttttctgaagagatataaggtttcatcgcatactttttcactgcgatggcagcgcataatccgactcctgcacctaagagaaaatgacgtaatttcaatatgaagcacctccaattatgtcgtagtttttattatacagaagatgccagacggtgttaagtaaagcggcggttttacagcccattcaatctgagcgcttggaaaacggttgtttttctaataaaataaaagcattacatagaaatgaggggaaaatatgaatgaggaaacgaaaacgcttttccggacgctgacgcagcttcccggcgcaccgggaaatgaacatcaggtccgctcttttatgaaacgggagcttgcgaaatatgcggatgacatcgtgcaggacagactcggaagtgttttcggagtaaggcgcggcgctgaagatgcgccgaccgttatggtagccgggcatatggatgaagtcgggtttatggtgacacagattacggataacggcatgctgagatttcagacgctcggcggctggtggagccaggtgctgcttgcccagcgtgtcgaggtgcagacggataacggaccgattatcggcgtcatctcaagcatcccgccccacattttaacggatgcccagcgcgcaaagccgatggagatcaaaaatatgatgattgatatcggtgccgatgacagagaggacgcggtcaaaatggggatcagaccgggacagcaggtcgtgccggtctgcccgttcaccccgatggccaacgagaagaaaatattgtccaaagcgtgggataaccgctacggctgcgggttaagcattgaactattaaaagagctgcacggaaaagacctgccgaacaatctgtacgccggggccaccgttcaggaggaagtcggcttgagaggggcgcagacagcggccaacatgattcagcctgatctcttcttcgcgcttgatgccagcccggcaaatgatatgagcggcgataaggagctgttcggccgtctcggcgagggggtgctgctccgcattctcgacagaacgacggtcatgcaccgcgggatgagagagttcgtccttgatatggcggaaacgcacaatatcccttatcaatatttcgcttcaggcggaggaacggatgccggacgcgtccacatatcaaacagcggggttccgtctgccgtcatcggcatttgttcaagatacattcatacaaatgccgctatcatccatgtcgatgattatgccgcggcgaaagaaatgctcattaagctggtcatggcgagtgacaaacagacggtcgaaacgatcagagaaaatgtgtaaaaaaaataagcagtcaataagtccctttgaatacttattgactgctgtttttacattctgttttaagccgcatgatcgagacagttctttgttgtgaatataagtgtaaagcgtattgtaaatagaattaggtaacacatattatttttcaatattattatcaaaatggttccgatccagataaacaaccttcgaacctttattgcaatgataaacgtttttaaatcaaaaacatgctgcaagcattgagaggagcagcgatttcacaaagtcgagtcatttgcatttttatttgttctgcaagaaggtatgattatgacaaaaaagacaaatataaactttcctcttgaactgattaatactgaagtggtgagtgtaggtaagcaggaccgcataaaagcggcctgcttattctgtttcaaataaataagagagtgctttcatcgcttgattgacggtttcgaccgtgatattcgcttttccggaaagctctttcagcggatgatgaagttctttcggacggatgagaatgagcggctttccttttgcgatggcataagaagcatccatcgcggtattccactgtttatatttctcgccaaacagggcgatcacaaaatcggctttttccatcagcacctctgtacggaaattgttgatatcagaagctctggcgtcttttaaaacagaatcgggctgcacgcccataatctcttctccgatattgtctgagcgttcatggttttccatcggaccgacaaacgtaatcggcaggttcagcgcttttgctttttgtttgatttcatcccgccaatcactgtggatttcacccgctaaatacacgacaaactgcatcttttgcccctccttatgtacatattcagattttcgtacggctacaagcaaaatggtaaacgaaacttgcttgataatgcaaatgaaatatgataatgatattgcatatagttggtcttgccgtaaacagtctggtatgatccaattggacaaacatcagcatataaaaaactcataatccagatggaggaatgacaatgaaaaagattgaaagcacggaagaattgcaaaaagcggtacaagacgattgggcggtatttatgttttcagcggattggtgcccggactgccgctttgtggagccgtttctccctgagctggaagcggactttcctgaattcacttattactacgtagaccgcgatcaatttattgatacatgcgcggaatgggaaatttacggcattccgagctttgttgtgtttaacggaggaaaagaagtgaaccgcttcgtcagcaaagaccgtaaaacaaaagaagaaattgagcaatttttaaccgattcccttgctaaagcataaaggaggccacgggctttgaaaatgacgtcaaggaagctggcggatttattaaaacagcgcctgcagcacgagaaccgatccttcttttttgacagagaaaaagacaccctccgtgttgaggatcaaacgaccaaaaaaggcatcacattggagctcccgccgatcattgcgaagtgggagacgaaaaaagaagaagcgatcgacgaaatcgtctactatgtgtcagaagcgatggaggcgatggaaggaagcggacaggagatgtccggaaaggaagccggaatctatccggtcatccgctccacgtcatttcccgatcaaacgagcgacggcattccgctcgtgtatgatgaccatacggccgaaacgagaatctactacgcgcttgacctcggcaagacgtaccgcctaattgacagccgtatgctcgagaaagaaaactggacaaaagaacggatcagggagacggcgtcattcaatctccgctctcttccttcggtcgtgaaacaggatacggttgcggataattatttttattttttcagggcgaatgacggctatgacgccagccggattctcaatgattcgattcttcatgaatataagcaggccgctgaaggcgaattggcgatttccgtcccgcatcaggatgtattaatacttgctgacattcgaaatgaatcgggttatgatattttagggcaaatgtccatgagcttctttgcaagcggcacggtgccgattacggccctttcatttctgtataatgaaggcagactggaacctgtgtttatcatggcgaaaagccggccgaaaaaggattagaaaggatttttcttatgaacgctttttacaataaagaaggtgtgggagatacgcttctgatctctcttaaagatgcagcacgcgaagaaatcggctatgaaagagaaggcgatgtcgtcagaatctttaacaaagaaacaaaagaaacgacgggctttaacatttttaacgtgtcttcttacttacagattgaagacaacggccccgtcgctttgtctgagactttcgtacaggatgtgaatgaaatactgaacagaaacggcgtttcagaaacgctgacggttgacctttctccgaaatttgttgtcggtcacgttgaatcgaaagaaaaacatccgaatgcggataaactgaatatctgccaagtgaatgtcggagaggaaacccttcaaatcgtttgcggcgcgccgaacgtggacaaagggcaaaaagtcgtcgtcgctaaagtcggtgcggtaatgccgagcggacttgtgattaaagacgctgaattaagaggcgttccgtcaagcggcatgatctgctccgcgaaagaactcgctttgccggatgcgccggcggaaaaagggattcttgttcttgaagacagccgcgaggccggcgaagcatttcaattctaactcccataaataagcgcacagaatcgaatgatgtgagagaaagccgttaagcaggcctgcttaacggctttcttcagttgggagcttaatcttttctgagccgcccggcaatggtatactaaatatcgtcccagactactaaaaagggagttagagagtgattaaacatgagttggctgaataaattttttgacttatttttaggtgaaaaagaagaagagcatgaacgtgaaccgaacacgcatgcccaaatccagaaacagcaaataccggatcagccagaaggcaaattaacgcgcatggaagattctaaaatatattacgaatatccgaaagggaatttccgcttcccggtcgttccggacggctataagcgaacggagcaaaaccaaagacagcgggaaaggcacgaacgccgccagccgtcccggggttatgccgccgggaaggagcaaacggagcggaaacagcatacacataaagagcctgatacggtgaaaaagccctttaaaccgtcatccattccttcaccggtttacggctttcaatctcagcacagcatcaaaaaagcgcctatttccgaaaagcggcgtgaagagaacgtaacattgctgtcagaggagcaatttgttccgccaaaatccggtcaggaaacggaaaaagagcccgtcttcacaacatccggtataacaaaacagacgaatgaccggccagaaccgtttgcgaaacaagaaacggaagaaattccggccgttaaaaaagaggagcttcacacggaggctgagaatgcaaaagagcaagtgtttgcagcaccagaaccgcagcaggctgaagagctggagcacaccgaaagcgcggagtctgccggctttacagaagaacaagagcatgaacaaacccgcccgcagcctataagagagcctgagtctgaagcatcccgaacggctgaaaacacagaggaacaagcggcgccggagggggaacatcaggagcctgagccggaaaaagcaccgccttttgaaaccgcagaagaaccggtgtatacatacacagaacccggatacgaggaaattcagccgcagtctgaagacaagcccgaatcagctgaacccgacgcgaaacaggaagcagactctcagcctgagtacaatgaagcagagcggcattcagaccccgagcctgaacctgtaagcattgagacgaccgatgccccatcccggcctgccgaagaaaaaacggagcatcacggacagcctcagactgtgagaaaagcggagcagccgaaagagcgcaatgttccgtttaacgtcatgatgcttaaaagcgataaacacaagcagacgaagacgccagagggcggagcgagctatgtctttccgaatctgtcgcttctggacgtaccgccggcgcaaagacatgacgaccaatcgtggattgaagaacagcgcgagcttttaaacgttacactgaaaaactttaatgtgcgcgcccaagtcgttcatgtcacacaaggcccgtccgtcacacgttttgaagtgcatcctgagcccggagtgaaagtaaacaaaattacaaacttagcagatgatattaaactgagcctgtctgccaaggatattcggattgaggcgccgatccccggtaaaaacacgatcggcattgaagttccgaaccgcgtaagcaaagtcgtcgatttaaggcagatgatcagaagcgccgctttcaggacgaatccgtctccgcttacagccgcgctcggtgtcgatatttccggaaacccggtcgtcattgatttgaaaaagatgccgcacgggttgatagcgggtgcgacaggatcgggaaaaagcgtctgcatcaataccattttggtcagtctgctttataaggcggatccgagtgatgtcaaaatgcttctgattgatccgaaaatggtcgagcttgcgccttataaccaaattccgcatttggtcagccccgtcatcacggacgccaaagccgcgaccgccgcgttaaaatgggttgtggaagagatggaacggcggtatgaactgtttgcccattcgggtgtgagagatatcggacgctttaatgaattaacggccgatcataagacaggcgaaaagctcccttacctcgtagtggtcattgatgagcttgccgatttaatgatggtcgcgccgaacgatgtggaagaaagcatcgccagaatcgcgcagaaagcgagagcctgcggcattcatctgcttgtcgcgacacagcgtccgtctgtcgatgtcattaccggaatgatcaaggcgaacataccgacgaggattgcattctccgtctcaagccaggtagattccagaacgatcatcgacatggcgggagcggaaaagctgctcggaaaaggcgacatgctgtactgggaaaacggtaccggaaaaccggtgcgcctgcagggcaactttgtatccgacagagagattgaccgcgtcgtctctcatgtcagaaagcagctgccgccttcttatttgtttgaacaggaagaactgatcaggcagggaaccgcccttaaggaagaagacgaactgtttcctgaggcgtgccaattcgtcgtggagcaaaacagcgccagcacctcaagccttcaaagaaggttcagaatcggttataaccgcgccgcgaggctgattgacatgatggaagccgaaggcatgatctcagaagcgaagggcagcaaaccgcgtgaagtgctgattacggccgctgacatttctcaagaataagaatatcgttcatttttctcacaaacatggtatgatagtggatggaccatcaaaactgcatcactgtcacgcgctgaaatatcatgcggcaggtttaatcaaaaagaaagttacagatactgacgataacgtaaaaataaatggaagcgccgctgtgcgggcttttcgcccgctgcggtcgcaaaatgaaatgagcgtcatatactggggaacagatagacgtttgttggaggtacgattatgactgtttatcattttgttggaataaaagggacaggtatgagcccgcttgctcaaatcctgcatgatacggggtatcaggtgcagggatcggatatcgagaagcagattttcactcaggctgcccttgaaaaaagaaatatcccgatctatccgttcagcgccgataacatcaaacccggcttaacggtaatcgccggaaacgcattccctgattctcatccggaaattgcaaaggcgctcgatgaagggattcctgtcatcagatatcataaatttttagctgaatatatgaaaaaatacacaagtgtcgcggtaacgggcgcacacggcaagacgtccacaacgggcctcttggcacacgtgatgcagcaggcgaagccgacttcgtttcttatcggggacggaacgggcagaggaaatgaaagcagcgaatactttgtatttgaagcttgcgagtaccgccgtcatttcttaagctatcagcctgattatgcgattatgacgaatattgattttgaccaccctgattatttcgccaacattgacgatgtgtttgatgctttccaaaacatggcgcttcaagtcaacaaaggcatcattgcctgcggtgatgacgagtacctgccgaaaattcacgccaatgtgcctgtcgtttattacggcacgggagaagaaaacgattttcaagcgagaaacatcgtaaaaaatacggaaggcacgacatttgacgtctttgtccgcaatacgttttacgatacgttctacatcccggcatacggccatcataatgtcctcaattccttagcggtcattgcgctctgccactatgaagaaatagacgtgaacatgattaagctcggacttgaatcattcggcggcgtcaaacgcagattcaatgaaaaagtgatcggcagccaggtactgatcgacgactacgcccaccatccgactgaaatcaaagtcacgattgaggcggcgcgccaaaaatatcccgaacgtgaaatcatcgcggtatttcagccgcatacgtttacacggacgcaatcattcctggatgaattcgcagaaagcttaagcgcggccgaccgcgtgtatctgtgcgacattttcggctctgcccgtgagaacgtcggcaagctcacgatcacggatcttcaggaaaaaatcgataacgcagaactcattgaagaaaatgacacttccgtgttaaaagcgcatgaaggcgcagtactgatcttcatgggcgccggagacattcaaaaatatatgagggcctatgaaaacgtcatagcgtaacgaaaaagcagtggggctctcactgcttttttgcgcgtgctgcaaagggatttaccgataaacggagaaatagtatacatacagacctttcatatatgtttatcattttaagaattgggtatataccactatatcctgcattaaggaggtattagatgatcatcattctttacttaagcgtcgcactcattgccgttgcatttctcatcctcgtcatctatctgtccaaaacattaaagtccgtgcagatgactttaacaaacgtagcctcgactttagacggccttgaagggcagatgaaaggcattaccgcagagacaaccgagctgttacataagacaaaccgtctcgcggaagacattcaggaaaaatcagagaaattaaatacggttgtccatgctgtccaggaagtgggaacttccgtccagcagtttaatacatccataaagcaggcagcaggttctgttacggcctctgtaagagagaatcaggataagatcagtcaggttgtcacctggagccaggccgctatggaaatatgggacaagtggaagcaaaagaaaaaaacatcgctttaatcataagaaaaatccactaaggaggaatcataatgagcaaagatggaatcaatagtaaggattttttaatcggaacgctgatcgggggaattatcggcgcgacaacggcgttgtttctggcgcctaaatcaggtaaggagctgcgcgacgatctcggcagtcaggcttctgcgttaaaggataagacggacagaatgacggccgacgcgaaagaaaaaggctctcaatatgtcagcatcgccaaggacaaaacatctaatatcacccagctggtagctgatcagtcaggtcagattatgaataaagtgaaggatttaaaagaccgttctaagagcacactaaccgagaaagccgaagagacgagaagcgaaatgcaggacacggcccaaagcatcaaggccgaagcggaagacgccggggaaaaagccggtcaggcaaatcgctgatcttcaataaggagagataaccgacatgacaaaacagctgatatcgtctgaagaagagttcaaaaatgccgctgagaaagaaaacacgctcgtgtttttaaaacacagcacaacctgcccgatcagccaagccgcgtttcaggagtttgacgcctttgcatcggagcattcagaagtaccttcttattacctgcatgtgcaggacagccggccgctttcaaactatatcgccgaggcatacggcgtgaaacatgaaagcccgcaagtattcgttattacaaacggcgaagtgaaatggcacgcgtctcattcacaaatcacaaaaaacgcaatagagcagcacctttcataattgctggccgccggttgataccggcggtttttttttgaaaaaaactattgatcatttcagccggatcatgtaggatatcaatatatactgcttcaacgcataaaagcttaaaagcgtttttgtgataaagtcgaatgtgaaaaaatttattatttcatattcctattttcgcataactgtagtaagatgcatgttaaccattaaaataaaacatagcatagaagggatgaaaaagatgagcaacaaggaattagagagtctaagacagcaggcagacgcactaaacttagaaatccttaaattaatcaatgaacgcggagccgttgtaaaagaaatcggtaaagcaaaggaagcacagggtgtcaaccgatttgaccctgtcagagagcgtacaatgcttaaccgcattattgaaagcaatgacggcccatttgaaaactcaacgatccagcatattttcaaagaaattttcaaagccggacttgaacttcaagaagaggatcacagcaaagcgttgctcgtctcccggaagaaaaaagcagaagatacgatcgttgacattaaaggtgaaaaaatcggtgacggcgatcagagattcatcgtcggaccttgtgccgtagaaagctatgagcaggttgccgaagtcgcggccgcagcgaaaaaacaaggcattaaaatcctgcgcgggggcgcgtttaaaccccgcacaagtccgtatgatttccaaggtctcggcgtagaaggcctgcaaattcttaaacgcgtcgctgatgaatatgacctcgcggtgatcagtgaaatcgtaacgcccgcccacattgagcaagcgattgattacattgacgtcattcagatcggcgcgcggaacatgcaaaactttgaattgctgaaagccgccggttccgttaaaaagccggtattgttaaaacgcggtcttgccgcaacaatttcagagttcatcaatgcagctgaatacatcatgtcacaaggaaacgaccaaatcattctttgtgagcgcggaatcagaacgtacgaaacggcaacgagaaacacactcgacatttctgccgtgccgattttgaaacaggaaactcacttgccggtgtttgttgacgtcacacactcaacaggccgccgcgatctcctgcttccgacagcaaaagcggcgcttgcgatcggcgctgacggcgtgatggccgaagtacaccctgatccttccgttgccctttcagactctgcgcagcagatggatatccctgaattcgagaaatggctgaacgaattaaagccgatgctgaaagtaaaagcataatacaacgttccgctctttaaaggccgcctcgcgcggcttttttttcgtatcttcattttatttaattataaaatgaaagtgaacgttttcatcattgggaaaaacgtgtataatttcatgagagatatttaaatttgatgaataatgaaaaataatgtacactactgacttacgcttacaatcataaacgacagaatgcgaaatcgtacgacatttctttacataaagtgtttatgctatagataaggataagtgtatccagtaaaaggagtggtttcagtgagcaacattacgatatacgatgtggccagagaagcaaatgtcagtatggcgactgtttcccgcgtcgtgaacggcaacccgaatgtaaaaccgacgaccagaaaaaaagtattggaagccattgaccggctcggctaccgcccgaacgcggtggcaagagggcttgcaagcaaaaaaacgacaacggtcggcgtcatcatccctgatatctcaagcattttctactcggaacttgcgcgtggaattgaagatatcgcgacgatgtacaaatataatattatcttaagcaactcggatcaaaatcttgagaaagaactgcatctgttaaatacgatgctcggcaaacaagtggacggtatcgtatttatgggcggcaacattacggacgagcatgtcgaagaatttaagcgctctcctgtgccgatcgtcttggctgcatcagtggaagaacagggcgagacgccttctgtcgccattgattatgaacaggcgatttatgatgccgttaagcttttcattgataaagggcatcgcgatattgcattcgtctccggaccgatgcaagagccgatcaaccgttcgaaaaaactgcaagggtacaaacgggcgcttgaagaagcggcgattccgtttaacgagcaattcgtagcggaaggcgattacacttatgattccggtatggaggcgcttcaaagcttgatgggccttgaccggaaaccgacggcgattctttctgcgacggatgaaatggccctcggcattatccatgcggcccaagatcaaggtctttcgatacctgatgatcttgatattatcggttttgacaatacgagattgagcctgatggtccgccctcagctttcaacagtcgtgcagcctacgtacgatatcggcgccgtggcgatgagacttttgacaaaactgatgaacaaagagccggttgaagagcatatcgtcgaattgcctcaccgcatcgaattaagacaatcaaccaagtcataaaaaaacggaaaagcaagcttcactctgaggggtggaatcttgcttttttacttgagtaaggagaagatatgaaacgttttgattatctgacgcccgttggctttatgttaggctgtattattgtcgcaatcggtattctgtcagggacgggactggcgggaatcagttcatttttggatctgacttcttttttaatcgtcacaggcggccttgccgcggcggtctttatcagctttccgccgagggatttaaagaaaaccccttctgttctgaaacaggtattctcccgtcaggatgacaatgtgaaagagcttgtcagagtatttgtcagcctttcggagcaggcgcgcaggcaggggctgctgtctctggatgaccaggcgcgggagatcaaggatccgtttttaaaaaaagggcttttgcttgcgattgacggctgggacgaggaaacgatccggctggtgatggattctgagatcgccgcaatggaagaaagacacagaaaaggaagacgcgtttttgaaaaagctggtgatttcgcacccgcctggggaatgatcgggacgctcgtcggactcgttctcatgctcaaaaacttaaatgacccgcataccctcggaccgaacatggccgttgcgctattgacgacgctgtacggagcgctgcttgccaatttggtgtttatcccaatcgcggcaaagcttgaagaaaaaacggaaagtgaaattttcatcaaacaggtcatgatcgaaggggttgtcggcatccaatcgggcaaaaatccccgcaacctcgaaagtcagctcgtcgtcttcagctcaagagaagactggcgtaaaggacagcctgcgaacaagaaaaagggcgctgtccatgaagcttagaaaagagcgttttgaaagaagaaacaaaccggaacattccggcggttcaccgagatggatggtgacgttcgctgacttgatcacgctcattctcgtgttctttatcttgcttttttcgatgtcgcaaatagacgcggaaaaatttcaatctgccgtttcatcgattcatacaaacggcagcggaggtgaaccggcgtcatcagacaaagcaaacgaaaataaagaacaggatttgctgttacaaaacgtgaagacatacataaaagcgcatcatttgagttccaaattgacggcgaagcgcgatgagcgcggagtggttcttgtgctgcaggaggccgttctgtttcagacgggaaaagcggatgtgctgaaaaacgccgagccggttctgcatcagatcgcggtgcttttaaaaacaattccgaatgacatacaggtagaaggccatacggacagccgccggatttccacctatcaattcccgtcgaactgggagctgtcgtctgcaagagcggcgagtgtgatccagtattttaccgcgaatgaagacttttccgccaaacggtttatctctgccgggtatgcggatacgaaacctgtgaaggacaacaaaagtcccggacatatgaaagaaaaccgccgtgtagaaatcgtgatcaaaaaaacgacctcctcataaggtcgttttttattttgttttataccgctgctcagaccggatggcaaaaagtgctttttccacggtttgggcatttttttctgaaatttcttctttgcgtggaatcggaggatataattgttcaggatcactccaaaaagcgggcagcgtgcagggggaatgcttctgccatttatcaatccatttctgcggtatgcgctccccgggatcaatccctttcatctcaagccaaatgcggctccatgctctcgggacgactctccaaatatcgtatccgccgccgccgaccgcgatccatctgccgctgcaatattgatgggctaatgaatgagcgagccgcgggatctcctgataaatggagattgtattggacaggtgtgtcaatgggtcgtaataatgggcgtccgcaccgttttgggtaagaatcacatccggcttaaaaaaagccgcaatttcagaggcggccgttttgtaagcgtggagaaaggaatcgtcctctgtgaaagcgtccagcggaatgttaaaagaatagccgtagccttgcccgcttcctttttccagtacttgtcccgtcccgggaaataaataacgcccggtctcgtgaaaagaaacagtgcagacatcagacctgtcgtaaaacgtaaattgaacgccgtcgccgtggtgggcgtctgtatcaatgtataacacttttgccccgtagttcttctggatgtattggatggccacggcgctgtcattatagatacaaaagcctgacgccctgccgcggaagccgtggtgaaggcctcctcctaaattgcaggcatgcctggcttgtcccgtcatgacataatctgccgccgttaaggtgccgcccaccagaagcgacgcagcttcatgcatgccggcaaaaacgggggtgtcttccgttccgagaccgtagctttctccttctgcggcagggagccggcccgcacccgcaagttccaccgcctgtatataatcctccgtatgaacgagagccagctcttctttagtggccgtgcgcggtttgacgatgtctccatcgtcaaacgcgtccgccgcctgaagcagatcgtatgttaaaagcacgcgctgctgattgaacggatgatcctgatgaaattgatacgtctgataagaaggcgagtaaacaaaaacgctgtctctcatggctgatccctcaaatgtttcggccataagacattgtatccggcttcatgaacggcacggataaaagggagcggattcatcgtcttcacccggaagacgagaatgttcgacccggcggaatcatggggatagacgagcacactcaggatttgcagctgaagatcacggcacatgcagctgagatcagcaaggctttttgtcatatccgtcaccaggatttccacctgtgatcccggctgggccgcgcctgtcaggctgacgaaagtccggagcacgtcggttttcgttaaaatgcccgtcagcttatgatttaccgtaatcggcagacagccgatgccgtgctcataaaaggaagcggatatttcttccacaaagtcaagcggatgggcgcagatgacattccgcttcataatggtctccactttgtttgtcagaaacgcgccgcgttccttttgttcgaagctgccggggccggcctgtttaatgtctctgtctgtgacaataccggtgacgtgcagctcgtcgtcgatgacagggagatggcggatatgatataccttcattttacggacggctgtttcaatggagtcgtgttttgagacggtgatgacgtcccgtttcatgatttgttctgcaatcatctttttatcccctttgtatgtcagtcaatacataaaccgctgataaaaacgaagcctgtcgaactgttcaattgactcctgactgacgtgcctgccgatgcgggccatcagacaattggccggatgagagctgatttccggttcatccgttgcaaaccagacaagacccccggcattcatcatcttttccatgatctttctgtattcccacacatcttttttcattccttttaaatcccaatgccagtaatattccgtcgtcatgatgatgtagcgttccatctgttcatccatcatgctgactgtcagcaacgtttttccgacagaacagcccctgtagccgggagcgacctcgatcgccccgagctcaaggagatcttccatattgccgtcagaccaccgttcaagcggatcaggatataaatacgtcacatagccgataatcgtctgtccgtccctggcgataatgatccgaccttcaggaagcccggcgatctcgattaacgctttgtgctgttcatgaggaaggcgaaaggctgtcaggccttcatgaaactcatactgtgctaggtcctttggaggaacgggcccttctaccaatagagggccggctgctgtctgaattgatgaagaatggtacgttttatgatgtttcactgattcaccgcctgtcggttcttaataaaaacacatctctcttaagcataacaaaatataaagcgttttcaatagtgttgtaatttatattttaaaaattgagaaaactgtgaacatctactataattagtctatagataagcaaagggggatgttgcatgaatttgaaagcgttgccggcggaaaaggggaattatcatctgcgaaattatgaggaaacgtaccgcagcttcgattggaaagaggtcgaagcggagttttcctggcatcagacggggaagctgaatgcggcgtacgaagcaattgaccgtcatgccgaatcatttcgaaaaaacaaagtagcgctgtattacaaggacgcaaatcggaatgaaaaatacacatttaaagaaatgatggaggaatcgaaccgggcgggaaatgtactgagacggtatggaaacgtggaaaaaggggaccgcgtttttattttcatgccgcgttcgccggagctgtactttatcatgctcggcgcaattaaaatcggtgcgatcgccggccctttatttgaagcgtttatggaaggcgccgtcaaagaccgcctgttgaacagccaggcaaaggttgtcgtgacgacacctgaactggccgaacggattccggcggacagcctgcccgacctcgagcatattttcattgtcggcggcagcaaagaagcgggagataaaatcattcattatgataaagcggctgagggagaaagcacgagacttgatattgaatggatggacagaagagacggctacctgcttcactacacatcaggatctaccggaacgcccaaaggtgtgctccacgttcatgaagccatgattcagcaataccagaccggcaagtgggtgcttgatcttaaagaagacgatatttattggtgcactgcggacccgggctgggtgaccgggacggtgtacgggatatttgcgccgtggctgaacggagcggcgaatgtgatcgtcggcggcagattcagtccggaaaactggtacggcacgattgagaagctcggtgtcagtgtctggtacagcgctccgacggctttcagaatgcttatgggcgccggagatgaaatggcatccaaatttgaccttacttcacttcgtcacgtcctgagtgtcggagaacctttgaaccccgaggtcatcaagtggggacataaagtattcggcaagcgcatccacgacacgtggtggatgacagaaacgggcggacagctcatctgcaattatccttgcatggagatcaagccgggctcaatggggaaaccgattccgggagtggaagcggcgatcgttgacaatcagggaaatgagcttccgccgtaccgaatgggaaatctcgccattaaaaagggctggccgtcgatgatggattccatttggaacaacaaagagaaatatgattcttattttatgccgggcggctggtatgtttccggagattctgcttatatggatgaagacggttatttttggttccaaggcagagtcgatgatgtcatcatgacatccggcgagcgcgtcggcccgtttgaagtcgaaagcaaacttgttgaacatccggcgattgccgaagccggcgtcatcggaaagccggaccctgtccggggagaaattattaaagcgtttatcgcgctcagagaagggcatgagccatccgatcagctgaaggaggacattcgcctctttgtaaaacaggggcttgccgcgcatgccgcaccgcgggaaattgaattcaaagataaacttccgaaaacacggagcggaaaaatcatgagacgtgtgctgaaggcatgggagctgaacctgccggcaggcgacctgtccacaatggaagattaaagacggcgttgacatcgtatcttatttatgttaaaaatgagtaagcttcatacgaaaaggttttgattgagacaagtaggatatctgattgttccagagagctgatggccggtgaaaatcagcacataagatatgccgaatacactcatgaaccgcttttgcgaacaaagctattccaaggctttcagtagtgaaagaacggacacggtccgttatcaaaaagagtgataaaagcttttttatgtttttattagtagggtggtaccgcgattatatcgtcccttcgttttaaacgaaggggcgttttttattttcataaacaaaggagcagacaaaatgactaacttattagaggatttatcattccgcggcttaatccagcaaatgacggatgaagaaggactgaataaacagctgagcgaagaaaaaatccgtttatactcagggtttgacccgacggctgacagcctgcacatcggacaccttctgccgatattgacactgcgccgtttccagcttgcaggccaccatccgattgcgcttgtaggcggcgcgacgggactgatcggcgatccgagcggcaaaaaagcggagcgtacgttaaatactcaggatatcgttgtcgaatggtcgcaaaaaattaaaaatcagctttcccgatttttagatttcgaggcaggagaaaaccccgctgtcatagcgaacaactttgattggatcggaaagctgagcatcattgaatttctccgtgacgtcggaaagaacttcggaattaactacatgcttgcgaaagatactgtaagctcaagaattgaaaccggaatttcttacacggaattcagctacatgatcctgcaatcctacgattttctgaatctgtacagagaaaagaactgcaaactccaaatcggaggcagtgaccagtggggcaacatcacggccggtcttgaactgatcagaaaatcagaagaagaaggggcgaaagctttcggtcttaccattccgctcgtcacaaaagctgacggcacgaaattcggcaaaacggaaggcggcgccatttggcttgataaagaaaaaacatcgccgtacgaattctaccagttctggatcaatactgatgaccgcgacgtcgtcaaatacttaaaatactttactttcttgtcaaaagaggaaattgaagcttatgctgaaaaaacggagacagctcctgagaaaagagaagcgcagaaacgtctcgctgaagaggtgacggttcttgtacacggccgtgaagcgcttgagcaggccgttcatatctcccaggcgctgttcagcggcaatattaaagagctttccgctcaagacgtcaaggtaggatttaaagatgtaccttcgtttgaaaaagaccgctctcaagaactgtctttagtagacgtgctagtggaatctaaactgtcgccttcaaaacggcaggcccgcgaagacattcaaaacggagctgtttacattaacggcgagcgccagacggacatcgggcatcttctgactgcggaagaccgcattgaagatcaatttaccgtactgcgccgcggaaagaaaaaatacttcctgatcacgtactgaaaataaaaagcagtccggccgctccatgcggcaggctgcttttttatgttttgtgaatactgcacggggaaatgagtacagtacatagtataagcaaaacagggaaggggtgctgcgccgtgaatttcatgtttaccatcgccaaagaaagattgcagcgggatcattgggaacagcagcaaagcataaacgccgaagccgaggaatcagagacggaagaagaaaatccgacatcataaaggtaaagcctccattctatggaatggaggcttttgattgtcaccatatcagcctgacggcggccatcagcacgactcccgtgatgaccgtgatggataagctttttgtcagcatcgcgcaaagcaatgtcgggatgagaacgatcattgctttccaatcaaaggtcaaagcgctgtttgttttcacaatcatgttttccgttaccagagccgtcaaaatgcaaagcggaataaaggagagccattttaaagccaattcaggcatctgaatgttccggacaaatataaacggaacaatgcgcggcacaagtgtaacaatcatgcagccgagtataatccagatcatttgtgtgctgatgctcatttgtccgtcaccaccccgatcgttgccacaattacggttgagacgatgaccgcgatgtgtgacgggacgaaatacgataacaagaccataaaaatgatcatatagagaattaaggagaggctgtgcttcagcttttccgaagcggacgactgcaattgcagcacaagcagcgccgcaaacatagcgggcaaagcaaagtccaggccgagagcgtaaggatcagatatccattgtccgagaagcccgcccatcacgcaggaaataacccagcacatgtaagcggttatattgaggccgttcatccacttatcgtataacctgccgttctgagccgctttgttcaccgctactccgaaagattcgtcagtaagcagagccccgaagccgatatttttcgccagagagtatttcgtgaaatacggcgcgatggtcaggctcagcagaaggtgacgcagattgacgataaacgtcgttaaaataatggcggaaatcggactcccggaaacaaggagcgagcaaataataaattgggcggcgccggcatagacacacaaggataacaaacagatttcaagaatgcttagatgagaggcaaccccgacgatgccgaaagcaaaaccgatgctcatatagcccagcagcgtaggcacacaatcccgcaccccctgtaaaaacgtatcgttcatttcccgggaaacggcggttttttgcacttctgtattaatcattttttatactcctttcatagagattataatgataacgactaatgaaaaaatcaaagaaaatacggttcacatttatatgaaccgatttccggtgacgacatgaaataacgaatggttttgtttcatcaggccttcaactttttcagccccgacttctttcacaagctctgcgaacatcagatcgtgcctcatatattccatggccacgagaacgagagcggggtcttctgatttaatggcccaggcattcgtctgcggagaaaaattggcgattaagacttctttattatctcgggcagctatcgttaatcttccgcccatccgtttctccgccacttcaggagacatattatgatttgtcgtatttccgagcttcacttccggagggccgaacacaatcgaaaagacgggcaattgttcggcggcgcgtttattagcggcttcttgaataaagggaatctgctgttcccagacagacagccacaactcttcctcggctttttcaatcatttccttcatctcattgatgacatgatcatttgtgctgatgcggcggatgacattcatctcctgctcgctttccagcgccaataacttttcctcaaggtagccgaatgagctctcgaaatcgtgccggagccggtcgattaattcctttccggccagcggggcatatgtaaccggatcagacggcacaatatggacagcgcctttatcaactaatttccccaatacctcatagatcattgagcgggggacgcctgaccttttgctgatttcatatccggtaacaggcgagtgtttcaacaagccgatatatgctttacattcatattgagaaaatccaaacttctgtaattctttcagaacatcatccataaacatcctccgtagtggttattcatgaaactactataatgtaagcggttatatcttgtcaatgggacttgagtgctgaaagaaaggttcgcctgttttgtcgctttccaacttagtttatgatgagttacatgtatggcttttgtgaaaaacgttgccgtagacccacacgaatgccgtttgatacgataaatacaagaagtcaaaaagaggaggatcacggtggaaaacacctctaaaatcgcttttttatcggttataagcaattccctggtcgtcatgctcaaaatagtggtggggataataaccggatctgtcgcgatactttcagaagccattcattcttttttagatttgatcgccgccttcatcgcctttatctccgtcaggatttcaaaaaagccggctgatacagggcatccgtacggtcatggaaaagtcgagaatctgtcggggaccatcgagacgatgctgatttttgcggcagggatttggatgatatatgaatgcgttcaaaaactggtcaacccggctccggttcatctgcccgtattgggaatcgttgtgatgcttgcgggggctctcattaatttgatcgtttcgaagttcgtaaaaagagaagccgaaaaggttaattccgtggcaatgaaatcgaatgccctgcatttactgactgacgtgtacacatcattaggcgtagcggcaagccttttggtcgttaccttaacggagtggtacatacttgatcctattataggtatggtgctggcggtgtatatcatatatgaagcgtttaagttaatgaaagaagcattcccgccgctgattgatacccgtttgtcggaagaggaagaaaaaacaattttaaagattatcgaaacatttcaacaggaatttattgaaattcacgattttcgtacaagacgctccggcccgcaggagtatattgattttcacttggtcgtagcctctcacgtggcgattaaagacgtgcacgacctgtgtgaccgcattgaaagagctattacgaatgaattcaaacaagcacaggtaatgattcaccccgagccggagagcgagaggaagaaataaatcgatcttaagtttgcgtttgttccctgcaaaatgcctgcaaaaggcccgtttccacgggtctttttgttgtataaatgactatttctcgctcatatgagagagaagcttatacacgtgaggggtacatttcatacgttatgttgtaaagaaaaagggaggtgaacagaattgaacgctatttctgttaaagaaattgaacatggagttgccgttgcggaaagagaaggtttaggggagtatttataccaagaaccggtttccaaaaaatgttcgcgccgttcccgcagcagaaaacggacacaccgttcccgcagcagaagacggagtcatcaccggacacaccgctcccgcagcagaagacggacccatcaccggacacaccgttcccgcagcagaagacggacgcatcaccggacacaccgttcccgcagcagaagacggacgcatcgccggacacaccgttcccgcagcagacggtcacatcaaaaacgtacccgcaagcgctgttttaaatgctgaagcagactctattacaagtaatggagatctgctataatggcaagagaactgcataaaagatccggtatcatcatctgcggacactgaactgacaacatggcgctgtttgttcgtgtccgttttttatgtcaaaaaagatgccggaggataaaaaggaagggatgacgccgaatgaagctgaatgaggaattttataactctgaaggaaagacagtctcttcgcaaaacataagcagcaagcttttgcatatcacggacagcgggcatatcagcattgacttcatcagcataagcaggctgcggaaggcttcaaaaatcgcgatcttaggtgacagcgtcgcccgggggctgcgcgcggaatacggctttggtgacattctgaaagaccggacagacgctgaaataaccaatctgtctgtcagcggcgttaatatgagcaaccacggaagcgataacatttatcagcaagcgcttaaaacaaagggacatgatgtcatcattgtccagggaacagatgatgattggtgcaaccacattcccatcggcacagatgaaaaggatatcaccacattttacggaggcttctgtcaagtgattcagcagctgcgaagcggaaataaaggcgcgagcaccattgtggtgaccccaacgagacaagcaaaaatatcaaaaggaaaaatcgtccgccgtgatactgataaaaataaactgggcctgaagctggctgactatgtgaaagcccaaaaagaagcctgcacactcctctctgtaccgtatgccgacctgtttgatacagatctcatcgacccgtataatcccgctttccgcagcatgtgcatgtcagaaggtcttcatccgaacgagaaagggcatcaaatcatttttcaggaaatctgccggaattattattactattacgggtaacacagcgctgcatgattattttcggccttgcttttctaaaagctcaattattctttgagatgcgtgtttttgcgctctcaaaagcgaaatgatattaccggtaaaaccgattaaaatgatcagcagcaaaatgatcatccacataagtgaacctcccgtcgagtgttgaaaaacccactctttattttacttattatggatggggaagagaataggtctaactattggtgtttctttatcaatccataaaaaaatgcacagactgaacgggtctgtgcatttttattcgcttatttcagcaggttcaatgattcacgattaaaggcttccaaatcgtcaggcgttctgctcgttacgatgttatggctcacgatgacttcttcatctttataatgtgcgccggcattgattaagtctttgcggatgctgcggaatcccgtgatatcttttcctttaagaaggtcggtatcaatcagcagctgcgggccgtggcagatcgcgaaaacgggtttctgattttccacgaatgatttagtgaattcacccgggcggtcatctccccgcagaagatctggtgaaaagcctccgggaatcaataacgcatcgaattccttggggtctgcgtctgagatcgcttgatcgatctttactttctcaccgtgcttgcccgtcacttctttccctgcttctaaatctattgtcaccacactgtggcccgcttctttaaatgcttccgccgggcttgtatattcaatatcctcaaattgatctgtcatcagaactgcgatttttttgctcatcatcatgcctcctgtgaatttgtatatgacaagaatatcaggcggattgccgcctcacaacgtatttgcttgaagatacggcatgaaaaaagacccctctgaaaaagaggagccaaaaggtacggaggtctgctgaggcaagaaatcgaaccaattactttttgcgtctttttttatcctttttacacccgcatttccccggatcgcccggatcaatgacttcgtgaattgtttcttcctgataaacgtggcggggaacataacggatatgttctctgttaatgtgtttgatgggatggacgtaaaccacttctttgtcagtatacttgtcagtcacaatatacttagggtcacagtaatacactttcgattttttacccattcatctcacctcccgtactttattaaatgctgaaaaggaggattttgcatcggacaagtacactatggcaagtccacaattttccatccgcaatttcgtttatctggtttttcctgaatccgtctcaaattggaatggctaaccctttttgaacggggaaatctataaaaaagaattcaaaaacgattcttttttcaggtcaatcgagatgcatacatctttagggggatttcagaatgctcgatgaaaaaacgattgaaatcattaaaagcacagtgccggtcttagaagagcatggtgaagaaatcacaggccgattttatgacctgctttttcagcatcaccctgagctgctgaatatctttaatcagacgaatcaaaagaaaaaaacacagcgtacggccttgtcgaatgctgtgattgcggccgcagccaatattgaccggctggaaaacatagtccccgtcgtcaaacaaatcagccataagcaccggagtatcggtgttaagcccgagcattatccaatcgttggaaagtacttgttaatcgcgataaaggatgtgctaaaagacggggctgctcctgaggtcattcaggcatgggaaaaagcatacggcgtcattgcagacgcttttatcggaattgagaaggacatgtataaacaagcggaaacgcaaaaaggcggctggaaagacgataaggcgtttaaaattgataaaaaggtaaaagaaagcaaagagataacgtcgttttatttaaaaccggaagacggacaagttctccccgaattcaaagcgggacagtatatcagtgtaaaagtatacattccggacacgggttatacgcatatccgccagtacagtttgtcggatgtatccggtaaggattattaccggatttccgtgaaaaaagacggaattgtttcttcatatctgcatgaccaattacacgaaaaggattcaattgagatcagcgctccggccggggatttcgtattagaccctgattccaaaaagaatctggttctcatcagtgccggtgtcggaattaccccgatgatcagcatgttaaagacggttgccaaaacccagccgcagcgaaacgttctctttatccatgcggcaaggagcggagagtatcatgcgctgcggcatgaagctgaagaagccgcggaacactcatccgctgacaccgtctttatttacagcgaaccgtccgaacaagaccgttcagaaaacattcgttttcgggaaggccggattgacaaacagctgttagaagaagtgatgacagataaagatgctgatttttacctgtgcggatccccgtcgttcattaaagaaatgaaaaagctgatttctgaattcaatataacgccggaatccattcactatgaattatttaaaccgcagctgagtatggtgtgatgtaacaacatcttagacagtctgtttaacagactgtctttatatgtttaatacgaaaggttttccccataacatagaattttcaagcaggtaaatcatattcaaagtcgtattatcctaaaaagacaaagttttttatgtcccaacatacttcagtagccggatggaaaggttctcttcctgatacttcaactggaacattggctcctgctcttgtgaataaaatagcaatgctctaataataagaggtggctcaatggcagtttttgttgaaaaaacgctccaaggtctaaaagaattaattgatgaaaaaggccgcttgaacattttagggaatgaaggaacgcttttagaaacagaatgtactttctttaaaggtgcaacagatctggagattgagagttttgagaagaaaataaaagtctcacttcctgaagattataaaacctttttaaaattgcataacggagccagaatatttgatttgttgatttacggtgagaatgtaggtgggggtttgcatattcttgatttagaagagattgaaaagtatatgcaaaatggttttttagagcctcagtttattcctgtcgcacatctgttagacggatgttatttgttaattgacaaaaccaaaatttctacagatccaaactatttatggttccgcggatttattgagtatgaaccaatgaaacttaattttgagatatttttagatcggtatattttgtgtcaaggagcaaatttttgggagtggaatatctataccgctgaaaattattataggactcaccagggtgataaggattaacctttcctacagttgggttggttcatttttgcggttagacttcgatttgaacttttaaaaataggtttaatttgggagacgaaccgattaattggtgtatagatgatttataaaaagcgcagatactctgcgcttttttatttaagtattttccggatcattcgcagcccgtttttggaagaaggataacggaaagcgaggtcgaagcggttcgtttgtttgacgacgctttttttgtgcgtaaatgcgttaaagctgttaaatccgtgatagctgccgatgccgctttctccgacgccgccgaatggcaaatacggtgtcgcgacgtgcattaacgtatcattgacacagccgccgccaaatgacagattctctaaaacagttcgctcgattcctttgtttgttgtgaagacataaagagcgagcggctttgggcgtgattggactttctcgatgacttcatcgatatcgccgtatgtaaacagcggaagaatcggcccgaaaatctcctcctgcattactggagagtcatccttcacttgatctagaatcgtcggcgctattttgtggtgttcaggattaaattgtccgcctgtaagcgggacgccatcattcagaaagctgagcagccgctgatagtggcgttcactgacgattttgccgtactgcggattttgttcaggctgagggccgtaaaattcactgatcgcatgcttcatttcttctatgagcttcgttttgatatcttggtggacaactaaataatccggtgcgatgcaggtttgccctgcatttgtaaatttcccgaagacgatgcgtttggcggcaagctgtatatcagcatccttatggacaatgcagggacttttgccgccgagctccaaggtaacgggaattaattgtttggaggcggcctccataacgatttttcccacggcaacgcttcctgtgaagaaaatatagtcaaagggctgctgtaataaaacagtgctgacgtcgggcccgccctccgccatagcgacataatcactcggaaaaacgctgctgataagtttagaaagaacagcggaaaccgcaggcgtatattctgacggtttgagaacgactgtgtttccggccgcaatggctccaatcaagggtgaaagcgccagctgcaagggataattccaaggcgcaatcaccaaaacgattccatatggctcagggataatcatgcttttcgagcccaggtgagtcagaggcgttttgactcgcttcggtttgacccattttctcagccgcttcatcacaaaactgatttcttccagaacaattccgatttctgtcgtgtacgcctcctgttcggatttgtggagatcctgatagagagcggctgctatatcggcttcttgtgttttgatggcttgtttcagcttttgcaatatgttcagccttgattctagcggtctcgtatgccccgccgcaaaataggctttgtgcttgctgacgatagaggggatgctgttcattccgtctctcctttttgtaagtatgatgattcattatgtaaaaaatcgcttctgcctgtcaaatgattaaggtgagtcagaaaaaataacaaactcatttctgcgtttcggcaggaatttgatgaaaaagagaattctttttgcggcattatctgttgcaggcattatggggttttctaatgtacatgtagttgaaaagccggttggcacataaaaaaaagccccggacaggggcttttttaataaagagagggaacagcccaaaagaaaaaccccggaaacattgtcatcacaacatgtccggggtttaatccaatgctctttaaagagcgttttacttaacgggagtagaactcaacgataagcgcttcgttaatttccggagcaagctcagagcgctctggaagacgagtgaatgtaccttcaagcttttcagcgtcgaaagtaaggtactcaggaacgaagttgtttacttctacagattctttgatgatagaaaggtttcttgatttttcgcgaacaccgattgtttgaccaggttttacttggtaagacggaatgtcaacgcggcttccgtcaacaaggatgtgaccgtggttaactaattggcgagcttgacggcgagtgcgtgcaagaccgagcttgtacacaacgttatcaagacgtgcatctaaaagaatcatgaagttttcgccgtgtttaccagtcatttttgccgctttgtcaaacaatgtgcggaattgacgttcgtttacaccgtacatgtgacgaagtttttgcttttcttgcaattgcaaaccgtattctgatagttttttacgctgtcccggaccgtggggacctggtgcgtaagggcgtttttctaattctttacctgtaccgctaagagagattcctaaacggcgggacagtttccaagatggacctgtatagcgagccataatgtgactcctcctttggttttattttgtggaaaataaaaaccgtctgttcgatccgaccgtgcacattttgttttcatgtatcctcgctccagcagcagagagttacacgatacaccttacagctaaggaacaaaatgcaaacacagaagctgaacaaaaaggctgcaatatttcacacaaagaacattatatgatttttccccgccgccgtcaaccatttctccatgaagagtgccggtttatgatataatgtacaaaaatgagtagtacatgtttaggtgataaaaatgaaaaaacaaacaattgatgaagtgacggcctttcatcagaaaatgctttcttttttcttaacgaaatctgaatccgtctcattatccgactcgctgttatggctggcctcagctctagaatcctgctttacatctctttcattgaccctttcaccggcagaatcaacacgtttcaccataaaaacagaagatgaaccgcattatgctccgctgaaagagagtgacggccgttttatgatcaggaatcagacgtccggcagatccttttatctgcgctcggaaggcgggctgccgatcccggaatcattgcctgagatcgttactcagtttatcaatcaatctgtgagacaaagcgggctgtttgacaaaacgaagcatcagcggaaaattcacagaatgacagaaatgttccattcgcttttggatcaaaatgaggttttggaaaaactgcaggcaagtttgagtacggctttccggtctttccgcttttcactgtttatcacgcaggatcaggatacggacagacagcttcccgcaaaagaattacatatggatggaaaagatgccgatccgtctgccctgaaggtttatttatcggggagactgctcagaaaaggcaggtcatctgcttacctgccgatcaaaggccagcaggggacttacggggttctgaagacggaggggctgcaggatgccgttctttcgtgcagtactctcagtgaaatgctgctgcttgcgggcgcggcgggaaaagcatttgaaaatgcgcagctctatgagcaatcgaaaaaaagcattgcgaatctggagctcattaatgaaacatcgcgccagctgaatcagcgcctcagactcactgacacgatgcgggaactcgccgccattatgacccaatcatttcatgcggaagaagtggctttttttcatattgatcattttgagacgcaaaatctgcttccgggacataccgctttttttaagacagaacgtgcgaacccctatatcagcattgtgaaagaaaagctgttcgagggagaaaagggcgtgtttatcggcagcggaaagactgtattcggcgaaaacggcttcggctcgctgatggcggtgccgatgatcgaaaatgacaccgtcttcgggttcgcgattttattgaaaaaggatttgtatgcttttacgtttgaaatgtataagctttttcaagcgctcattcaccatgcgacattggcggtcacgaactccatgctgcgcgacaggcttgagcatcttgttcagacagaccagctgacggagctgtattcaagaacctatttggatgagaaaattcaatacagcatgaaaattcataaacggggtgtattcatcctcgttgatatcgataatttcaaaaccattaatgatacatacggtcatcaaacgggagattcgatcctgattcaggtggcctccgttatgaaaaaccatattcgtgagcatgatgtcgctgcaaggtgggggggcgaggagctggctgtctatctgccgaatatcaacgtgtcatccggagaacgcatcgctaaaaggctggttcgcgccatccgggaaaacaccgagccgcgcgtgacgatttcctgcggcgtttcctgctggtcaaagacaggcccgatgccgttgaaaatgctcgttcagcaagcggacgaggcgctttatatcgccaaacggaacggcaaaaaccggctgatcatccaccaaaacagcacgacgacataaaaaaggagccggcctgccggccgggctcctttttttatcctaatcgtttttcaagcgtttcaacaaactttgctaaataggcttcgtccgtttcatcaaaacggtttttcacagggctgtcaatgtccagcacaccgatcacttcaccgtttacgcggatcgggaggacgatttctgactgggaagccgcgtcacaggcgatatgtcccgggaacgcattcacatcggcaatccgctgcacggcgccgttagagtaggcagtgccgcatacgcctctgccgaacgggatgcgcacacaggcaggaagtccttgaaacggtccgagcacgagctcgccctctttagcgaagtaaaaccccgcccagttgacttcatgtaatgaatggtataaaagcgctgatgcattcgcgtaatttgcgatcgcatccgtttcatcttctgtcatggcttcgagctgtttaagcagaagctgataacttttttctttatctccggattgtttttcgacatgaaacatggaaaaccctcactttttctataatatcaaacaaagttccggccgttctgccggcatttgtcgagaagttcttacaggaacggcgcctttctgcttgaattgttacacataaaggggtgagccgtatgaaagtaagcaccaaagacaaaattattaacgccgctgtccagctgtttaaccaaaaaggttattccggcacgtccgtccgtgaaatcgcaaagtcagctgatgttaatgttgcgcacatctcctactattttaaagggaaaggcggattaatggaacatttagtttccgagttttacgaaggctatactgaagcgctggaaaaagccgccgtcagtttgaacggtgaagacgcgcaggaacgcatcctgcgggtgattttcgatattttatcctatcagcacgataaccgtcaactaacgcggtttgtgtaccgggaagtgacgattgattccgtgcttatcagggaaattatgtctacttacttaatgaaagaaaaatatattttccagctggtgattgaagaagggcagtcacgccacagacggctgacgctgcccgtgccgcattttattctgcaattgaaatccctcttgatgatgccgtatcttcagcctcaatacattacagaggtgctctatatgcagcctcatgaaccgtacttttataaaaggtattttgaagaggtgaagatctggatcgaaagcgtgttccgacggcctgatgcggcgcttatgaagtaatgatgcttttgtacgtttcataggaactgccgacatcttccgcttgatgggcgtccgacccgaatatgagcgggatttttttttgcttcgcggtctcagccatccaatcctccatgtatacttccccggcaaacttctttctgagcccggatgtattcacatccagctccattccgtgttctttcacggcgtcaagacagcgggccgcaagctctcttatttgaggtgacatgctgtaagggaaaaggcgtgcgaattttttgacgagcgtgatatggccgacccgttttggcttaaaggggccgagcggtgttacaatggaagaatacacagtttcatagtattgttcatatacggcttcaacgcttccgaagtgcgcggcgagctgctgaaaggcgtgctcgtcaaaatcgaggcagatataagacggaccggtcttcaaaaaatgaacggataaaatgccgtcatccagtgaggggccgtacgtgttcagaaacgccgcggtttcctcttcataccctgtgataaaatcagtttcgagcccggtcagaatgctgatttgtccatcgtattcctttttcagctgtgacagccgctccaaataaacctccatctgtctgagatccatcgcgctgtcctgaagcggtacgggatcttgaaatgacggaggaaggggggcgtgctctgtaaatgtgatcgagtcaaagcctctttccagggccttttcgacatattctttcagcgcatccttcgagccgtgagggcaaaaaggcgtgtggatatgagcgtctcgtttttccatttgtgtcactccattaaaaaattgcagaatcctgccgaaattatgcaaaaagtttttgatttctggtcaaaaaatgttggttacatggtatcataataacaatgaaaacgacagattttctcaatacatatattgaaatctttctgaatacataaaacaccctgacagattaagagaacaacaagggggctcattatggagttagtcatcggattattggttatactgctcgcgctctttgcggcgggctactttttcaggaaaaaaatttatacggaaattgaccggctggagtcatggaagattgaaattttaaaccgttcgatagtggaagaaatgtccaagatcaaacatctgaaaatgaccggagagacggaagagttctttgaaagatggcgcgaagagtgggatgaaattgtcacagcccatctgccgaaagtagaagagctcctttatgatgccgaagagaacgccgacaaataccggtttaaaaaagcgaatcaggtgcttgtccacatcgacgacctcctcactgcagccgaatcaaatatagaaggcatactgcgtgagatcagcgatcttgtgacgagcgaggaaaaaagccgcggagagattgaacaggtgcgtgagcggtattcaaaagcgcgaaaaaaccttctggcgtatagccatctctacggagagctatataacagcctggagacggatctcgacgaaatctggagcggcataaaaaagttcgaagaagagacggaaagcggcaattacatcaaagcgagaaaagtgctgcttgaacaggaccgcagactggatcagcttcaaacatacatagatgacgttccgaaactgctcgctgactgtaaacagaccgtgcctaaccaaattgccaagctgaaagacggctaccgggaaatgacggaaaaaggctacaaattggagcatattcaaatcgaaaaagagctggagacactcaccaatcaattgaaacgggccgaaagcgcgcttttggaagaattagatgtcgacgaagcgtccgccattcttcagctgattgatgaaaccattcaatcgatgtatgaacagctggaaggcgaagtggaagccggacagtccgtattaagcaaaatgcctgagctgatcatcgcgtatgagaagcttgaggaagaaaaagaccgcacaaaaaccgaaacggagctcgtcaaggaaagctatcagctgacggcgggagaaatcggcagacagcatgctttcgaaaaacagctggaaacgatcggccggctccttgagcaggcgagagaaaagcttgacggtgagcatgtcgcttactcgctgctgattgaagaagtcgaggccatcgaaaagcagatggaagaagctcagaaagaacatgccgaataccgtgaaaatctgcaggcgctcagaaaagaagaactgcaggcgcgggaaacgctgatgaatcttcggaaaaccatttctgacacggcccgaatgctgcaaaaaagcaacgtgccgggaattcctgaacaagtcaaggacaagctcgagacggcaaatcatcatatagaagagaccgtcagccaattggaagagctgccgttaaacatggaggaagccgccaaacatctgaccgaagctgaaaaggtggttgcggaagtcagcgaagaggcggaagaacttgtgattcaggtgaagctgattgagcggatcattcagtacggcaaccgtttccgaagccagaatcatattttatccgaacagctgaaagaagcggaacggctgttttacgcttacagctataatgaagcttatgagatggcggcagatgctgttgaaaaagcagctcccggcgccgtgaaaaaaattaaagctgatcaatctgcttcatagacgcacaagcaaaaactgcaccctgatggaaatcagaggtgcagtttttttgtttctcacggaatataaaaagcgcctatggctgatatacatcaaaccgcaggcgctgaatgttacgattttgctttatttaattcgatgggcgggctgataaaaaacgtgatgatgcagccgatgatcgctccggcaatgcccggaagcacccagccgattcccatgctgtaaagcggaagatttgcgtttaagaatgaatctaatgatccgagcggaatgccggctgccttcaaaccgtccaggatactgaacagccccgttccgatcaggcaggcgatatagacttcgcgtctttccttaaagattttatcaataaaggaaagtacgataatgacaatcgccagcgggtaaatggctgataaaataggaactgaaaatgcaataatctcagcaagtccgaaatttgaaatcgccagactgaacagcgtgacaatcgtaaccaccattttgtatgataaagcgggaatcaattttgaaaaatattcgccgcaagatgtgacaagcccgatgcttgtcgttaaacacgcaacggtgatggcggcaccgagaacaatgtttcccagtgaaccgaacaggtaatcagatgaagctgataaaatctttgcgccttcgccgagcggcccgacagcgtccgtgcttgtcgctcccaaataggccaaagataaataaatgaatgtcaaacccgccgctgcaatcagacccgctttaatacaagcggcggcgagcgctttacgctgggtgacgcccctgcttttaacagcgttgacgacaacgacgccgaagacgattgaggcgagcgcatccattgttttatagccttccaaaaatcctttgaacaccggcgttccggaatatgcctgatgtacggcgcccagcccgcccatcggagtgacgatggcttttacgacaatgattaaaataataccgaatttaatgggagtcaaaatctttccgactctgtccacgattttggacgggttaagagctaaataatacgtaatagaaaaaaagatcaacgtgaaaacaaataaagataatctttccggaatgccgcttaaaaacggaactgcaccgatttcatatgaaacggttccggttctcggaatcgcgaaaagcggcccgattgataaataaagcacaacggtgaaaatagtgccgaataccgggtgagccttatcggcaagtcctttcgcgtctttgcccgttaatgcgatggcgataatacctaaaagcggcagtcctacgccggtcagtaagaaaccgcccatcgctttccagacattatgccccgccgcttgcccaagctccggcggatatatcatatttcctgccccgaaaaaaagtgcgaagagcatgaaaccgataataacggtatctttgacaggtagtgagtgtttcataaaagtcctcctaaatactatgttgaaatattctgtcaattaattgtcagataatataacaaaacgaacattacttattatatggcaatgtacagagaagtcaatactcgatttattgcgaatttctatttacttttgttatggtagcataaatatcatacgatgtaccgttttcataaaaggagtaaaaaaaatgatatatttagacaacagctcaacgaccgagccgtatgaagaggttttggaagtgtataaacagacgagcagccgttatttcggcaatccttcgtctctgcaccagttaggaactgagacggagcagctccttgaagcggccgctcagcaaataaaaagaaccttacgtttaaaaaattatgatattgtatttacatcaggcgcgactgaagcgaataacgctgcgttaaagggagcggcctgggcaaacatgagtaaaggaagacatatcattgcttcggcgattgagcatccttctgtgacggagacgcttgatcagctgacagagctgttcggctttgaagtcacatatcttccggccgatcaaaacggcttcgtttctttgaaagacgtcaaatcggctatcaggccggatacgataatcgtcagcgtcatgcatgtcaataacgaagtcggctccattcagcccgtaaaggaaatcggcgggtttttgaagcagcaccggaatattctgtttcatgttgatcatgtgcagggcattcataaagttcctctgtctatagaagaagcgggcattgacctttgcactgtttcagggcataagtttcacggcttaaaagggaccggagcgcttatcgtcaaaaaaggaacgcggctcattccgcttataacgggcggctcgcagcaaaaaggcgtccgggccggaacagaacatacggcaggcgccgtttcccttgcgaaagcgatcaatctttccgcgcgtgacatgaatgagcggctttcttccgtggaggctgccaagaatgcgctcatggaaaggctgagcggggcggacggggtcgtcatcaacactcccgccgaaaacagcgctccgcatatcattaatttttccgttccgggcgtgaaggccgaagtgctgctgcacatgcttgaggaaaaaggaatatatgtctccacaaccgcggcatgttcggcaagagagcataaaccgagccgtgttcttctgcaaatgaataaaggcgaacaggttgcatcaagcagcatcagagtcagcctgaacttcatgcatacggctgacatcacggagccgtttatggccgcgctggtgccggctgttcaaaaactaaaaaaaatgatgaggtagcatatgaattacgatcatattttaatccgttttggtgaaatatccacaaaaggaaaaaacagacgcagttttattgaaagattaaaacaaaatatccgcctggtattaaaggattataaaaaagtaaaatacttttcaaaccgggaccggatgtcaattacacttaatggagaaaacccggagggaatttgttccttattaaagaatatattcggcattcaaagtttcagtctcgcaattaaatgcgaaagcaagctggaagacattaaaaaaacggctttagccgcgatagaaggcgaatataaaccggggaatacgtttaaggtcgagaccaaacgggcttacaagcagtttgaattagatacgaatgcgatgaacgctgaaatcggcggccatattttgaaaaacacggatggattaaccgtcgatgtgaaaaatcccgatattccgcttcggattgaaatcagggaggaagcgacattcctgaccattcgtaacgaaaaaggcgccggaggccttcctgtcggttccgcgggtaaagcgatgctgatgctttccggcggttttgacagtccggtcgccggtttttacgcgatgaaacggggattatcagttgaagccgtacatttcttcagtccgccgtatacgagcgaacgggcaaagcagaaagtcatggatctcgcgggatgcctcgcgaagttcggcggcagtatgacgcttcatatcgtgccgtttacaaagacgcaggaactcatccaaaaacaaatcccggaaaactatacgatgacggcgacgcggcgtcttatgctgcaaatcgcggacagaatcagagaagaacgaaaagcgctcgcgatcattacgggggaaagcctcgggcaggtagcgagccagacgcttgaaagcatgtatgcgatcaatgccgtgacggcaacaccggttttgcgccctttaatcggaatggacaaaacagaaatcatcgagaaatcaaaagaaatcggcacttatgaaacaagcattcagccgtttgaggattgctgcaccatctttacgccgccaagtccgaaaacgcgtccgaaaaaagaaaaaatcgagcacttcgaaagcttcgttgattttgaaccgctgattgcagaggccgctgccggcatcgaaaccatcactgtttactcagagcaggaagctcacgataagtttgccggcctgttttaaaactgtatacaattaccaaagtttttttgaatgaagacatgtgttttatcacattctatactcacaaggaggtgatacacatgtcacaacaatcaaacagcggaaacagcaaccagcttttagtgccaggcgctgctcaagctatcgaccaaatgaagtatgaaatcgcttctgaattcggtgtaaaccttggaccggaaacaacttctcgcgccaacggttctgtcggtggagaaatcacaaaacgtcttgtctcttttgctcagcaaagcatgggcggaagcagccagcagcagttttaatcacaacttcacataatggctaagagagcggggaattccccgctcttttttcatgagtatagatagaaggctggaagcaatttatgcatatttttattgtaatggcctatgtttatgtataatggggaaagaaagtgaggagttgttcgtgttaaaacgagaagatttaatcgccccaaagaactataatcttgtaaatgaaatcgaaaagttcagccgttccaaagagaagaacgcgcttatttgggaagatcaaacaggcggcaagaaagtctggacgtatgaaaaattgatggaagaaacgaataaaatcggagcccgcctgaaaggtctcggatttgaaaaaggcgataagctgattgtcatggttccgagagtgcttgaagcgtatgccgtttatttagcgatcttaaaagcggggatggtcgtcattccttgctcggaaatgctgcgcgccaaagaccttgaataccggatcaaacacgccgaagtgaaaggcgctatcgtttatccttcatttataaacgcatttgacgaggtgaataccgagcagctggtgacattgtcaatcggtgaaaatgatgccggctggaaaaacctcttaacgattgaagcggacggaaacagttttcaaacagctgatacaacaagagaggacatggcgtttttgtcctatacttcaggcacgaccggccagcctaaaggcgttgtacatacacacggctgggcctttgcccatttaaaaacatcagccggtgcatggctggatatttccgaagacgatacagtgtgggccaccgcggcgcccggttggcagaaatgggtgtggagcccgctgctcgccgttctgggaagcggcgcgacaggattcatttatcacggcagattcaacgccaagacgtatttagagctgctggagcgccatcaagtaaatgtcttctgctgtaccccgacggaataccgcctgatggcaaaagtggaggagttggacaaatatgatctttctgcccttcacagcgcagtttctgcgggtgagccattaaaccgggaagtcattgacgtattccggaagcatttcggtattaaagtgagagacggatacggccaaacggagagcaccctgttagtcggcgtcctgaaggatatggatattaagccgggaagcatgggcaaaccgacccccggaaatcaagtagagattataaacgataagggcgaaatatgcgaaacaggcgaaacgggcgatatcgccgtgcatttgagcacaccggccttattcaaggaatattataaagatcccgaaagaacgaaaaagcagattcgcggagattattttcttacaggagaccgcgcgaaaaaagacgaggacggctacttttggtttgagagccgcaatgatgacattatcgtcagctccggatatacaatcggaccttttgaagtagaggacgcgctcgtgaagcatccggaagtgaaagaatgtgcagtcgtggcaagcccggatgaaatcagaggttcaatcgtaaaagcttatgtcgttttacaagacgatgaaaagcggagtgacgaacttgtcaaagaactgcaaaaccacgtaaaaacgattacggcgccttacaaatatccgagagagattgaatttgtcgaaagcctgccgaaaacggcgtccgcaaaaatcagacgtgtggaactgagacagcgtgaagaacggctgaaggctgataaaaaagcataatacaggataaagggtgagcggggatgaaagcgatttggcacggcggcaccatctatacaatgcttgacaagaatcatgtcactgaatccgtttataccgaagaaggcgtcgtcaggaagacgggcagctatcgggagctccaaggaacatacggttcgcctgatacggaggaaatcgatttacatggagctgtcatgttcccggggtttacggacagtcatatgcatttaatcggacacggggaaaaacagcttcgcctcgatttgtcgcagctgacgtcaaaagaagcgatcctgcgggccgcaaaagaagcagagcgtgaattggaagatggcgaatggctgatcggcgaaggctgggatgaaaacctgtttgaacggccggattacgtcacgaagcatgaccttgacccgctctttcccgaccgccccgtcctgctgaagcgggtatgccggcacgccgttgcggttaattcggccgcattgcgcgcggcggggattacaaacgaaacatctgatccaaacggcgggattatcgtccgggacggcaccggtccgacaggccttctgctggataaagcccaagagcttgtgacacaggccctgccgcccgtctcacttcactatgtcaaacgcgcgcttcaaacggcgattacggactgctggtcaaaaggcctgacaggcgggcattcagaagatctggcatactacggagacgcgtccgttcccgttgccgcgtacgagtctttaaccggcagcggcctttatccttttcgcgcccatctgctcgttcatcacgaagccgtcgacagctggagcgctctggataaatcgaccggaccttacctggaatacggagcgatgaaaatttttgctgacggcgcgctcggaggcagaaccgctctgttgaaaaagccttatcatgatgatccgtcagtttccggcgttcaggtgcacgatgacgagacccttgccgctcttgtttataaagcgagagagaaagggatggagatcgccgtgcacgcgattggcgaccttgcatttgaaaaggtgctcgatgttatcgaaagatacccggcaaagcccggacagctagacaggctcattcatgcgcaagtattagatgccggattgattgaaagagccgcccggctgccgatcggacttgatcttcagccgcattttgtggccagtgattttccgtgggtgattgaccggctcggagaagagcggatgaaaacggctttcgcctggaaaacactgctgtcaaaagggctgctgtgcgccggaggctcagacgccccgattgagccggccgatccgcttctgggcattcaatcggctgtgctccgtacaagcaagcagcatccggaaggtccggcctattatgaaaaagagtgcctgaccgtgtacgaagccattcagctttacacggagggaagcgcggccatcatccataaagaacatagccgcggacggatcgcccccggctatgatgccgactttaccgtactcagcggtgatccgttcgggacggatccgaaaaagcttcatgaattggaagctgtcaaaaccgtcgtcggcggccgtatcgtatatgaaaaagaggacaggcagtgatgcccgtcctctttttttatgataaaaatgatcgctttactttttcccagaaagagttgtctttcagtttcaccgttttgatttttttatcggatagtgtaatctcaacctttttgacattccgcgtgctgagcgcttcattatcaagcccgataatcggatgctcattgccgtcctggaccacctgcagtgtcagcttccggtctgagcttaaaataaacggagatccgagtgtacggtatgtgttgttgttcaacgacgccagttcggatacctgcatgcaggaaatcaaaggatcaacaacggcgcctgaaacagatttattgtaggcggtgctgcccgtcggggtggaaatgatcatcccgtctcctctgaacgtctcaaaatgaagatcatcaattaacacatccatcacaaacgttttaataatgcttgaacggatggaaacctcgtttaaacagtgaaaatgattgctgccgtccaccgttacatgaatgagcgggtattttctgacctcaagctgttccgcggtcatgctggccgccattttttcaggctcatcgctgtgaaaatcacagtacaaatgggctttcccttttttagcgatgccgacatacaggcagtcatcacggaatccggtttttctgacggcttgcagaaatgagccgtcgctgccgatgctggcgataattccggcatcctccgggtgagccgcaactgtaaaaccgtgcgattcagcaagctgcttcaaagagctgacttgttcttttgtttcgttgttttgtttgtgaaaaaaataaacattgcggcgaagatcggtcatatccccattcccctttgctgtcatatttacgtttttctcccagcaggtattgtgttaaaatacctgtggcaatagtgtaacatgtttcctgtttatccgttaagagaaagcgcttcatgaaaaaaatgaatctttttttacgggggaacgtacgaatattgacagaaaaggaggagaacaaatgaatgcaaaaagatggattgcgctcgtcatcgcgctcggcattttcggcgtatcggtcattgcaagtgtgaccgtcggggtgctgaagaatatcggagatacagggtctgactttgcatcactgacagatgacacagaggaagtgacgctggataagggcagccccggcagtaaaatcgccgtgcttgaagtggacggcacgattgaggataacggcgggtccgctggcctgctcagctcaggcgggtatgatcacagatcatttttaaaacaggttgagcgtgcgaaagaagataaaagcgtcaaaggaattgtactgaaaatcaattccccgggcggaggcgtgtacgaaagcgcggaaatacataaaaaactggaagaactaaagaaagaaacgaagaaaccgatttatgtgtccatgggctccatggcggcatcgggaggctactatatttcaacggccgccgataaaatctatgcttcaccggaaacgctcacgggttcactgggcgtcatcatggaaagcgtcaattattccaagctcgccgatgaactcggcatcaagtttgaaaccattaaaagcggcgcgcataaagacatcatgtccccgacccgcgacatgacgaaggaagaaagaaagatcatgcagacaatggtcaacgattcttatgaaggatttgtcaatgtcatttcaaaaggccggcacatgtcaaaagcggatgtgaaaaaaattgccgacggccgtgtttacgacggcagacaagcgaaaaaaatcggcctcgttgatgagctcggtttttacgatgatacgatcagcgcgatgaaaaaggaccataaaaatatgaaaaacgcttcagtcatcacatacgaggaaggattcggattaggctcgctcttttccatgagcgcagcgaaaatgtttaaaagcgaaattgattttctgaatatgaaagaactcatttcgcaatccggttcgccgcggatgatgtatctctatgcaaagtaggggggaagaaagaatggacgcgacttacgaaggctttcacggcaaagaagaggaagccgaacaacagagggcgcccgagcaggcatatgcgggcttttggatcaggttttgggcgtttcttcttgattggctggtggtctggggacttaaccatctcatcgtttcaccgattttcacgctgatgaagctcccggcaacaagcggaatgtttacaatctcagcttattccgtcacaaccctgatcgtctacctcgcctattttgtgttcatgacgaaatggtttcatcagacactcggcaagatggtcttcgggttaaaggtcacttctttgacgcccggaaagccgctgacttggagcaccgtcattttcagagaagcggtggggcgttatatcgataaaatctggattctctatatcgtcattgcgtttacgcccaaaaagcagggcattcacgatctgatcgccgacacaacggtgattcacgaagcgctgtaccgcaaataaaagcagtaaacccggaataaacgtccgggtttattttttttggttttggcgataatgctgctaaggaagtgaagcctatgggatatgccgcagcagctgttattctcattctcattttggtctggctgctcatgaggatgaaaatccatctgactttcgaatatcttcacgataaagataacgacaaactgacgtttaaactctcggccttatacgggctggtccgttttaaaaaaacgctgcccgtcattaaagtaaacagcgaagacgcgtctattgatgtcaaacaggacacgaaatcagaaatgaaaggtcagaaaaaagagaagaaaaaaatcacatatgaagatgtcaaacagagcattcacagaatagaaatgattctgcaccaagtcttgcagatgcgccaaatcgccgcctcatttcttgcgggagtccgtgttacgaagtttgaatgggtgacggttatcggaataaaggacgccgccgttacgggaatcgccgccggcggattgtgggccgtaaagggaggccttacggcgatgctgtatgatcatctgcgtttcatacataaaccggtgtgcgaagtcattccgtcttttcaagtgcctgcatccaagacgcatttgcagtgtatattcttttttcgttttggacatcttataggtgcagctttcaaattgctcaaatacgggcggaacggactttctatcatacgaaagaaacagccggttccggttgcttcaaagaatgattcatcagtttaaggaggagcgcatatggcagaccaccccattcaaggtttaatgaaaaccgctatggaaaatttaaaagaaatgattgacgtgaatacaatcatcggcgatcctgttgaaacgcctgacggcagcgtaatcttaacggtttcaaaggtcggattcggatttgcggcgggcggaagcgagtttggaggaaagccggctgaaaaaagaaccgatgatgatgaaagaaaagagcagaaactcccgttcggcggcggaagcggcggcggagtatccattacgccgattgcgtttctgattgtcggaacaaacggcgtgcgtatgcttcatttagacgaaaacacccatctgattgataaactgttagactccgcgcctcaaacgattgaacgcatccagcatatgtttaaaaagaatgaaaaaggccggaaccaaaaaagaacggatatcgatttataacagaaaagttaactgccgcccgcagttagctttttttacgatgcggcataacctttgcagtttgcataaaactcgactatgatagagctatacatagataaagggaggaatcagaatggctgaaattacatttaaaggcggagccgtgacgctgatcggacaagaagtgaaaccgggtgaccaagctcctgacttcacggttttgacaaacggattagaagagaagacattagcagatatgaaagggaaagtaacgatcatatccgttattccttccattgacacaggcgtatgtgacgcgcagacacgccgcttcaacgaagaagccgcaaaactcggtgatgtgaacgtttatacaatcagcgccgaccttccgtttgcacaagcgcgctggtgcggagcgaacggaattgataaagtggaaacattatcggatcataaagagatgtcatttggtgaagcattcggtgtttacatcaaagaacttcgtcttttggcgcgttccgtattcgtccttgatcaggacggaaaagtcgtttacgcggaatacgtaagcgaagcgacaaaccacccgaattatgaaaagcctatcgaagctgcaaaagcgttaatcaagtaaagagagaaaaagagctccgggtgctgccgcggagctcttttcatggcaaggaggaaacagcatgcaacacgatcatgtcggtcagatttatgaacttttagatgaagccgcccaagtgatagcagaaggccttgagatttcttatattgaggggcttgcggaggcgggagagatgtattttcttgaaacaacggaccagcttccgcttcaggaaaaacaaaccggcgagcttaaaagcctgcttgcgaaagcagacttcagaaaatgggagcatgaatggatccgcaaggcgttccagctcgccattttaaaaggactgaaagataagtcccatccgaacagacagatgacgcctgatacgatcggccttttcatcagttacctcgtgaataaatttacgggcggccgaaaaggcctgacgttgctggaccccgcctgcggcaccggaaatcttctgctgaccgcggcaaaccagctttctgacaaagcgggaaaaagcttcggcattgaaatcgacgatgtccttctgaagatcgcatatgcgcaggcgaatctgcaggaaaaagaaatggagctgttctgccaggacagtcttcagccgttatttatcgaaccggccgatgcggttatctgcgatttgccggtcggctactatcccaatgacgaaggcgctgaagcgtttgagctgaaagcggatgaaggccactcatttgcccaccacttatttattgagcagagcgtcaaacatacaaaaccgggcggatacttattttttatgattccgaaccatctgtttgacagcgcgcaaagcgataaactgaagcggttttttgcggaaaaagtatatatcaacgccctgcttcagctgccggctactatgtttaaagatgaagcgcaggcaaagagcattttaatcctgcagaaaaaaggcgaagacgcaaagccgccgaaacaagcgcttttggcgaatcttccttcttttgcgaaccagcaggcgatgcgggagatgatggcaaaattggatcagtggattcaaaaagaaaaataatggcgaaaaagcagtgtgagacgcaaaattccgcgctgcttttcgctttttaaaatgaatggaaatcagggcgaaaacacaaattaaggaaagaaaataacattccgtaaggccgtgccgtccatttggcacaaatgagatttatcagaaaatatcgacttcgtattgtaagcggtaccaatgtggatgttgacttgaaatgctgagttgacaatgtttaaatggaaaagtcagatattttttggaccgcagttatggtctgggaaaaaagaacgaacaaacgaagaagaattttgataggagcgtcatttatgtctaaaattattgcaattaacgcaggaagctcatctttaaaatttcagttattcgaaatgccttcagaaaaggtgctaacaaaaggtttagtagaacggatcggtatcgccgacagcgttttcactatctctgttaacggcgaaaaaaatacagaagtgacagatattccggatcatgcggttgcggtgaagatgctgcttcacaagctgactgaattcggtattataaaggatttaaacgaaattgacggaatcggccaccgtgtggttcacggcggagaaaaattcagcgattctgttttgcttacggatgaaacaatccgtgagattgaagagatttcagaacttgcgccgcttcataacccggctaacatcgtcggcattaaagcctttaaagaagtgcttccggatgtgcctgcggttgcagtgtttgatacggcgttccaccaaacgatgcctgagcaatcttacctgtacagccttccgtacgaatactacgagaaatacggcatccgcaaatacggtttccacggcacttctcataaatacgtgacacagcgcgcagctgagcttctcggccgcccgcttgaagatttgcgtctgatttcctgccacctcggtaacggcgcaagtatcgcggccgtagaaggcggaaaatccattgatacgtcaatgggcttcacaccgcttgcgggtgttgcgatgggaacacgttcaggaaacatcgaccctgcattgatcccgtacattatggaaaaaacggatcagacggcagatgaagtattaaatacattaaataaaaagagcggactgcttggcatatccggtttctcaagcgacctccgcgatatcgtagaagcttcaaaagaaggaaacgaaagagcggaaacggctcttgaagtgtttgcgagcagaatccataaatacatcggttcttacgctgcgagaatgagcggcgttgacgcgattattttcactgcgggtatcggtgaaaacagcgttgaagtcagagaacgcgtgcttcgcggcttagaattcatgggtgtatattgggatcctgcgctgaacaacgtgcgcggcgaggaagcgtttatcagctaccctcactctcctgtcaaagtcatcatcattccgactgacgaagaggtcatgatcgcacgtgacgttgtccgtcttgcacagtaatgatcgaaaaaagcacatcctttagggtgtgcttttttattgaatgccccagaatcaaacgttacgatatgtttaatacataaacgatgaggtgaagcaatgagtgtgcatgaacataaacaagaagccccgtcagccgtgcgctgcaaggtgataacagtcagcgacacgagaacgaaagaaaccgacaaaagcgggcgcgtcatgatggatttcatcagagaagcgggatttgaaacggtcgcttatgacattgtaaaagatgaaaaagatgaattgcagaaagccgttttatccggctgtatggatgaatatacagatgcggtgctgttaaacggagggacgggcattgccgaaagggatgtcacaattgaagcggtcacgccgctgttttcaaaagaactcccggggttcggcgagctgttccgcatgctgagctatacggaggacatcggctccgccgccattttgtccagagcggcagcgggtgtgatccgaaataccgcagtcttctgcacgcccggctcctcaggcgccgtaaagcttgcaatgagtaaactgattattcctgaactgcctcatgtgctccgggaaatccgaaaagatttataaatgtataaaaaggctctgctccgctcaaaaaattgggtggggttttttttataaaaggcttgaaaaaacagaatttacttgttacagtgtatacatacaaaatgcatttttattaattaaaactaatttttatacaaagggagcttttaacatggcagaacaaaaaaaggttgtattggcatactcaggaggtcttgatacttctgtagcgataaaatggctgcaagaacagggatacgatgttgttgcctgctgcttagatgttggggaaggaaaggatttggcattcgttcagcaaaaagcgctggaagttggcgccgtaaattcctatgtgattgatgcgaaagaagaattcgcccgggagtacgcgctcatttctatgcaggcccatacaatgtatgaaggcaagtatccactcgtatctgcactatcccgtccgttaatcgcgaaaaaactcgtggaagtggcggaaaaggaaaacgcggtggccgtagcgcacggctgcacgggaaaaggaaacgatcaggttcgtttcgaagtatccattaaatcattaaatcctgatctggaggtcattgctccggtccgtgagtggcaatggtcgcgtgaagaagaaattgaatacgccgcaagccgcggcataccgattccgatcaatcttgacagcccgtattccatcgaccagaacctatggggacgcgccaatgaatgcggtatattagaagatccgtgggcggcgccgcctgaaggggcatatgacctgacagcatctcttgaaaacacgccggacgttccggaaatcatcgaaatcgcatttgaagccggtgttccggtttcaatcgacggcgtaacctacccgctcgctgatttaattctcaagctgaacgagactgccggaaaacacggcatcggccggattgaccatgtggaaaaccgcctggtcggcattaagtcccgtgaagtttatgagtgcccgggcgccatgactttgattacggctcacaaagagcttgaggatctgactttagtgaaagaagtggcccatttcaaaccggcaattgaacaaaaactgtctgaaatcatctataacggtttatggttctcgccgttaaaagacgcgctgcttgcattcctgaaagaaacccaaaagcatgtcaccggcgttgtgcgcgtcaagctgtttaaaggccatgccattgtagaaggacgtaagtcggaatattctctctacgacgaaaaacttgcgacatatacaaaagacgatgcgtttgaccatcacgcggcaatcggtttcattgagctttgggggctgccgacaaaagtaaacagcattgtgaaaaagaaggagcagattgaagcatgaagaagctttggggaggccgttttcaaaaaacaccggaaaagtgggtcgatgagttcggcgcatccatcacattcgaccaaaacttagtcaaagaggatattacagggtctctcgctcatgcggcaatgctgaaaaaatgcggcattctgacggaagaagaagaaggtgccatccgtcaagggctgcagactctcctgcaaaaagcagaggaaggagcgcttgaattctctgttgattatgaagatattcatttgaacattgaaaaaatgctgattgaagaaatcggaccgctaggcggcaaactccataccggaagaagccggaacgaccaggtggcgactgacatgcatctatatttgaaagatcatgtctcgcatatcatcgtgctgattgaacagttccaaaaagcgctgatcgaaaaagcggaggccaatgtcgagaccattctgccggggtacactcatttgcagcgggcccagccgatttctttcgcccaccatctgcttgcttatttttggatgcttgaacgggataaagagcgttttcgggatgctatgaagcggattaacatatcgccgctcggatgcggggcgcttgccggaactacgtttccgatagaccgtaactattcggcggagctgctcggttttgactccatttacgagaacagtcttgacggagtcagtgacagagattttattctcgagtttttaagcggcagcagcatgctgatgatgcacctttcacgtttgtcagaagaaatcattctatggtgctcgcaggaattcagattcattgaactggatgatacgtacgcgacgggaagcagcatgatgccgcagaagaaaaaccccgacatggcggagctgatccgcggtaaaaccggacgcgtatacggtgatatgatgggtcttttcacaattatgaaaggactcccgctcgcttacaacaaagacctgcaggaggataaagaaggcatgtttgacacagtaaaaaccgttgaaggaagccttcagattttcacgggcatgattgaaacgatgaaagtaaacaaagacatcatgaaacaagcgacaaaacaagatttttcaaacgcgacggaacttgccgattatttagctaaaaaaggcatgccgttcagagaagcgcatgaagtggtcggcaagcttgtgtacagctgtattgaaaaaggaatctatttaagtgacatggcatttgaagaattccttcaagccagcagtctctttgaagaagatatctataccgtgctcgatccgcatcatgcggttgaaaaaagaatgagcgccggcggaacgggttttcagcaggtagaacaggcgctcgtaaaagcaaaagcctgcgccggcatttaatttgctgaaatttccttcatattttcccgtcatatcagacaccctacatctataaaagatgggaggtaaaaggaatgcgcaaagaacaagaccgttacatctatgatgaaaaagaaagtgaagaaacggccaggcttatctcagaggcataccaaagcggttatgtcggcatggaggaagcctctgctccttcagaaaattaagctgtctgtaaagacggcttttttttcgtgcggacgaagtgcaaaaaagtgatattgccgtttgtttatagtaaagtagagggagaaacgtcttgattttattgaagcggctacgttgcctggggagggtattcaatgtgcgacatgctctaatcactgccggtacaaagggattgggccgaaaagtgactgaaatgcttctggaaaaaggcttttctgtcacagtgaattacagacaggacgaagaagcggtcgcttgtctgaaggcggattatcccgggtgccatgacagattgcaattcgttaagggcgatgtaacccggaaagaagatctcatgcggatcgccgatgcagcccttcagcggtttggaaggattgacatactgattaacaatgccgggccgtacatatttgagcgcaaaaagcttgccgattactccgatgacgaatggtatggcatgcttgaagggaatttaagcgccgttttccatctgtttaaagcggttatcccggtcatgagacagcagcgcttcggccggattattacatacggttttcaaggagcggaccatgcccccggctggcttcaccgttccgctttcggagcggctaaagtcggattggcttcgttaacgaaaaccattgcgattgaagaagccgaatcaggcattacagccaatatggtctgcccgggtgatattgtaggagatatgaaagaagcgtctatagaggaagcaagacggaaaatcggcaaagaaaagacgccgatcggcaggtccggaaccggagaggatattgcgagaatcatcgcgtttttatgtgaagaagattccgatcttgtaaccggaacggtcattgaagcaacaggcgggctgaatgtgattaacaggcatcaatccctgtaagttttttcgtttgtcaaaaagggaacttgataaatattaattttttatgaggtgaaaacgatgaaagtgacttatcacggacattctgtcattcaagtggaaacgaaaacccataacattatttttgatccgtttctgaccggaaacagtctgacaaatttgaaaccggaagaagtgaaagcggatgtcatcctgcttactcacggacacaatgaccatgtcggagatacagagcagatcgccaaacaaaacgatgcgctcgtcattgcgccgaacgagctggccgtttatctcggctttaaaggtttaaaggtccacccgatgcatatcggcggggcgcaccaatttgatttcggcaaagtaaaactgacacaggcgttccacggatcggcggtcactgatgaagaaaacaaaaccatcacatacaccgggatgccggccgggattttattaacgattgacggcaaaacgattttccacgccggcgatacggcgctgttctcagatatgaaactgatcggggaactgaatcacattgacctggcgtttctgccgatcggtgataacttcaccatggggcctgaagatgcgaaactcgcggctgaatggctgagagcgaaacaggtcgttcccgttcattacaatacattccccgtcattgaacaggaccctgacgctttcgctgaaagtctgcccggaggcgtcggcaaagtcatggcggtcggcgagaccattgagcttgcctgacatatgtgtcaaagaccttctgaatcaagcattcagaaggtcttttttgtggtgccgccttttttcgggcgtctcattgcgaatgaatcccccgtacccttataataaaagcagaagactgtccttagaggtgaaacgcttggcaacaaagcatgaacaaatcctatcatacatagattcgcttcctgtcggtgaaaaaatttcggtcagaagaattgcgaaagaaatgaaagtcagtgaaggaacggcttacagagccattaaggaagccgaaaacaaaggattcgtttccactattgaacgtgtggggaccatccggattgaacagaagaaaaaagaaaatattgaaaagctgacatacgctgaggtcgtcaatgtgatcgacggccaggtgctcggcggaaaagcaggtctgcataaaacgttgaataagtttgtgatcggggcgatggagcttgacgcgatgatgcgttatacggcggcggggaacctgttaatcgtcgggaaccgaatcaacgcccaccgccaggcgcttgaagcgggcgcggccgttttggtaacaggagggtttaataccgacgacagcattatcgagctggccgatatgcttgagcttccgattctctccacgagctacgatacctttacggtagccgcgatgatcaaccgggcgatctatgatcagctcataaaaaaagagattgtgctcgtggaagatattttgacgcccgcagatcggacagtgacgctgttccctaaggataaactggagaaatggtacgaaaagaactatgaaaccggacacggccgctttccggttatcgatcagcagatgaaaatccacggaatcctcacgccgaaagatatcgcggggcatgaccggtcagttcccattgaaaaagtaatgaccaaaaaccctgtcacggtgatcggaaaaacatctgtcgcctcagcggctcaaatgatggtttgggaaggaattgaagtgcttccggtgacagacgggcatcacaaactgatcggaatgatcagccgccaggatgtcttaaaagcgcttcaaatggttcaaaagcagcctcaggtcggggaaaagctggatgatattgtttcaaggggatttaaagaagaggaagataacaaaacgccggccgtttatcaatatgaagtcacgccgcaaatgaccaatcagctcggcacgatttcttacggggtgtttacaacgattttaacccaggccgccagccgatttttacgctcccgcaaacgcggcgagctggtcattgaaagcattacgattttcttcctgaagcccgtacagatggagtcggtcatagaagtgaaaccgcgcattttagaggcgggccggaaattcgggaaaatggaagtggaagtgtcaagccaaagcggcatcgtttcaaaagcgatgctcatggtgcagctgatggagagaagttaagggacacacccgggtcccttggcattcattatgcgtggtccctctccgcttcctttgcatggatgggctcataatgcttataggctttatacccggcccatgcgctgcctgctccgattaaaatgaagacgccgccgatgaccagggtcaggacggagtggaacagaatcatttggtttactccgtacaaaagcaccagcgcgcctaatgccatacttgatttagccgaaaaacattccttctccagcgcccgtttcgtctggattccttttactttgtaatacacgtaaaagcaggcagaaagcccgatgagaaaaacaaaaaccagcataaatgaaatcctccattatatgagtttgcaaaaccgtttataccgttgctgaaagattttccttttccatggataaagagtatgattaaatgaataaaaacgaaaaggagaaaacgatgaaatccgaactgatcagaaccatatcattatatgacaccattatcttacatagacatgtgaggcctgacccggatgcctacggttcacagtgcggccttacagaaatcctgcgggaaacgtatcccgaaaaaaatatttttgccgtcggacagcctgaaccgtccttgtcttttttatattccctcgatgaggtggatgacgaaacctataaagatgctcttgtcatcgtgtgcgacaccgcaaaccaaggcagggtcgacgatcagcgctaccattccggcgcaaagctcatgaaaatagaccaccatccaaatgaagatccgtatggcgatctgttatgggtcgatacgaatgcaagctccgtaagcgaaatgatctatgagctgtacctggaaggaaagcagcacggctggaaactgaatacgaaagcagctgagctgatctacgctggtatcgtcggtgatacggggcgcttcttattcccgaacaccacaaaaaagacattaaaatacgcgggagagctcattgagttcccattttcatcgtcagagctgttcaatcaattgtatgaaacaaaattaaatgtggtgaagcttaacggctttatttatcaaaatgtgtcactgtctgaaaacggcgtcgcttccgttttcattaaaaaagacattttggagacatatggaaccaccgcttctgaagcgtcgcagcttgtcggaacactcggaaatatttcgggtatccgcgcttgggtgtttttcgtagaagaagacgatcaaatcagagtccggttccgttcaaaaggtccggtcatcaacggaattgcccggaaatacaatggcggcggacatccgcttgcggccggcgcatccatcttcagctgggatgaaaccgatcagattcttgctgatctggaagaggtatgtaacgaacacaagtagaggggagaccctctttcttagtgttcatctgtcacggggatgaaccagcagccgaattcagtcaggtcttcgtagacgcggagattacagatttggagttctttttttatgagggaagcgagtgtgtctgtttctgcatatgcggaatagccttgtctgattcgggctgcatgatcttttgccaagcggcgttcactaaaaacctccattttcccttcctcccttcagaatcgttgaaaatgtctcatctacagtttataaaaaagcggagaaaaaagcgacagatctatggaaaatttttaaaaataacataattacgtcgcaaaagaaatatgaatttcgacagacaatctcgtataaatcgtcagttcctttacttcagctttaaattccttctcatttatggtgtatattttgttttcaattgtccgttttaaaagctcctttgttttatacacgctttcaatatcctttgtgatgacttcagaaatattatctttcacctgttcctcaaatttcatcttgtcaggctgggcgattctgtatttttcccaattaatcagcttcacatcaacactttggatgagaagtctttgcttattatcctcatttaatttatgaagatctttctgatagatggagatttggttttttaaatcccgcgcgtgctcccgctgcttttcaattaacgtcacctgttcttcctgaaacgttccgtatgtaaacagaaagaacagccagctgatgatggctccgcacatcattcccgcaaaaaaacgctgccatcccggttttttataatactcgggaattctcatgatgacatattctcctgggtcagccatgaaataatcagccagccggtctgcgcgccgcccattgctgaaataattaaaagaagctgtttgaagatgtcgcgcgtgttgccttcaaacagcccccgctcgaaactgtataccgcgtcaaatgttcccccgatggccgcgacaagcgcccagatcttcagcctgttcgccaattttgtgatcgccgtcagcggaggctcgcctgataaataagctccgaggccgccgatcagcgcgccgccgagcaacacaccgagggcgataaaataactgctgatgaaattcgccataaagccggcttcctgatccatatatacaccacctcacttttctatcatattgagcgaaacggacaagtatgatgatgagtcaaaaaagaacatttgtttcttaagaaaacccgtcttataatgtagaaagacaaaatgaacgtatgggaaaggagtggcggcattgtcttttgttcacctgcaagtacatagcggctacagcctgttaaacagcgccgcttctgtaaaagagcttgttacacaagcgaaggaactcggatattcatcattggcgctgacggacgaaaatgtgatgtacggcgccattgagttttataaagcatgcaaatcaaacggaattaagccgattatcggtctgacggcttctatatacacggacgatacggagcttgaagcacacccgctcattcttttagcggagacaaacaccggttatcagaacctggtgaaaatctcaagtgcgctgcaatccatggcaaagggcggcatgaagcgaaaatggatgaagagctatcatgaggggctgatcgccattacgcccggtgaaaacgggtacattgaaagcctgcttcaagccgggaagtttgaagaagcggtccgggctgccgaaggattccgggagctgttcggagacggccgtttttatttagggtaccagccgtttaaaggacatgagacgttatcagaagagattctccgcctgtcagccgagacggaaatcgctgtctgcgctgcgggagatgtccgctatatcaagaaagaagatcaagatgcgtaccgctgtctgtgcgctattaaagccggagagaaatgggaggatcagagcgggaatctgccggacttatacttgaggacgcctgaagaaatggcagagctttacacgcggcatccggaagcgattgaagcggccgcccgtatcgcccggcaatgccgggtcgatgtaagcctcggacagacacagcttccgtcttttccggcgccggacggcaaatcagccgatgactatttggcggagatctgtcatgaggggctgcgtctccgtttcggcactcctgatgagcgggctgtccgccggcttgaatatgagctggacgtcatcaggcgcatgaaattcagtgattattttctcatcgtatgggactttatgaagtacgcgcatgaaaagggcattgtgacaggcccgggaagggggtccgcggcaggctcgcttgtcgcttactcgcttttcattaccgacgtggatccgcttaaacattctctgctgtttgagagatttcttaatcccgagcggatcagcatgccggatattgatatcgatttccctgatacgagaagggatgaggtcattcagtatgtacaaaataagtacggggccatgcacgtcgcccagattatcaccttcgggacattggccgcaaaggcggcgttaagggataccgggagagtgttcggaatcagcccgaaagaagccgaccagcttgcccgcctgatcccgtcgaaaccgggaatgacgcttgaggaggcgaggcggcagtccgctcagctgaacaggcggctgtccgaatccgccgttcttcataaagtgtttcagatcgcaaggaaaatcgaaggtcttccgagacacacgtcaacacacgcggccggggtcgttctcagtaaagagccgctttcggaagttgtccctcttcaagaagggcatgacggcgtgtatttaacgcagtatgcgatggatcacctggaagatctcggtcttttgaaaatggactttttaggtttgcgcaacctgacgcttattgaatccattaaaacgatgattgaaaaagagacgaatacgaaaattgatttttccgagatttcttatcaggatgaaaaaacgttctcgctattgtcaaacggtgatacgacgggtattttccagctggaatcatcaggaatgagaaacgtgctgaagcgcctgaagccgtcaagactggaagacattgtcgcggttaacgcgctttacaggccgggaccgatggaaaatattccgttatttatcgatcggaagcacggacgggcgcgtgtggaagtgccgcacgaggacgtaagaaatattctcagtgacacttacggcgtcatcgtctatcaagaacagataatgatgatcgcctcgcgcatggcagggttttcattaggtgaagcggatctgctcagacgggctgtcagcaaaaagcaaaaggacattctggacagagagcgaagccattttgttgaagggtgcttaaaaaaggagtattctgtagtcactgcaaacgaggtctacgatctgattgtaaaattcgctaactacggattcaacagaagccatgctgtcgcatacagcatgatcggctatcagctcgcctatttaaaggcgcattatccgctatattttatgtgcgggctgttgacgagcgtcatcggcaatgaggacaaaatatcgcaatatctgcatgaagcgaaggggagcgggattcaagtccttccgccgtcaataaacaaaagcggttttccgtttgcgccggaaaacggagccgtcagatacagtttgcgggccgttaaaaacgtaggcgtctcggcagtgaaagatatttataaagcaagaacacataaaccgttcgaggatcttttcgatttctgctttcgcgtacctgcaaaaagcgtgaatcggaaaaccatcgaagcccttatattttctggcgccatggacgaattcaatcaaaatcgcgccgccttgctggcctccgttgatgtggctttagagcacgctgaactttttcgtgcagacgatgaccaaatgggattgtttttggaagaatcgttttccattaagccaaaatatgtagaggctgaggaatttccgctcgtggacaagcttcggttcgaaaaagaagctctcggtgtttatttctcaagccatcctttgtctgctttcagggatctcctgaaaaaacggggggcgcaaacgatcacagcagcgcggcagatgccgaagggacagctgtcaatcggcgctttgctcgcgggcattaaaacgattcggacaaagacaggtcagcatatggcgtttctcacattaagcgatgaaacgggagaaatggaagccgtcgtgtttcctgaccaatatagaaggctgtctccgctgttaaaagaaggcgcgcttttattcgccgccggaaaaatggaagagcgtcaggagaagacacaattcatcatgtcatccgcctctcttcttgaacagacggaggcagacagagcgccgtctgtttacatcaaaatcgaaggcagccggcacaatcaggagtttttggaaaagatgaagcgtattttactggagcataaaggggaaaccggcgtttatctatattatgaaaaagacaagcagacgatcaggctgccggatacttttcatattgaggcggaccatcaggcgttataccgtttaaaagagctgctgggccgcgaaaacgtcgtgttaaaatagtggtaacaataatcgttttgttatacaattgaaacaattgtgctatcttatttaaagattctgaaatttttcacctccagcgattgtaccagtctatgcggcagaatatgtaacaaagtacttaaaaggagtgtttagaatgtcattaagagaagaagcgttacatttacacaaagtaaatcaaggaaagctggaatcaaaagcaaaggtagaagtcagaaacgcggacgacttaagccttgcctactctcccggagtagctgagccttgtaaagagatttatgacgataaaaataaagtatatgattatacaatgaaggggaacatggtagcagtcgtaacagacggatcagccgttctcggtctcggtaatatcgggcctgaagcttcacttccggtcatggaagggaaagcggtgctgtttaaaagtttcgcgggcgtggatgcattcccgatcgcgcttgacacaaacgatgtggacaaaatcattgacactgtgaagctgcttgaaccgacattcggaggtgtcaaccttgaagatattgcggcgccgaactgcttcattatcgaagagcgcctgaaaaaagaaacaaacattccggttttccacgatgatcagcacggcactgccatcgtaaccgttgccggacttgtaaacgcgctgaaattatcaggaaaatccatgtcatccattaaagttgtggcaaacggagcgggagcggcaggcatcgcgatcattaagcttctttaccatttcggcgtacgcgacatcgtgatgtgcgactctaaaggagcgatttacgaagggcgtccggccggcatgaacgcggtgaaaaacgaagtggccaagtttacaaaccaagaccgcaacgatggctcgctgcaggatgtcattaaagatgcagacgtctttatcggcgtatcagtcgaaggcgcgctgacgaaagaaatggtggagagcatggcgaaagatccgattatcttcgcaatggccaacccgaatccggaaatcatgcctgaagacgcgcgcgcagccggcgctagcgtaatcggaacaggccgttctgatttcccgaaccaggttaacaacgtgctggcattccctggaattttccgcggggcgcttgacgttcgcgcgactcacatcaacgaagaaatgaaaattgctgcggttgaagcgattgcttcccttgtttcagaggaagaattaagcgctgattatgtcatcccggctccgtttgacaaacgcgtggctcctgccgttgcgaaagctgttgcgaaagcagcgatggaaacgggcgtcgccagaattacggtcgatcctgaagaagtggctgaaaaaacaagacagctcacagtcatcggggaataataacacaaaaatgaaatggcagcgcgttggaaaaaacaacgcgctgctgttcaatatacggactgctggcatttttttaagggcaggtcttaaaaaaatttcagcagaatccttatttcttttgaaaacgctgacagataaggctgaacaacgctttttacggtatgaaatccgtccgtttccgtctgttttgcagcaaaaaatgtcgaatggaggatgacaccgtttgacaaaaaaagtacaatagtttcggtaaagttattattaagtctatctaatcggaagacatgcagtgaagagaacccttcacaaaagggaggtaatcatttgttaaaggatatattcacaaaaaagaaaaaatatgcttccgtgccgtctgagcaggcaaaacatgatgttccggaaggcattatgacaaagtgccccaaatgtaaaaaaatcatgctcacaaaagagttagataaaaacctgcgcgtctgcatgaactgcgggcaccatttcccgatgaatgcaaagcagcgcattgaaagcctcctggatgaagattcattcgaagaattcaaccagggaatgatatctgaaaacccgctcggtttcccggaatacttagaaaaaatcgaaaaagaccgtgagaaaacatcgctgaatgaagcggtggttaccggaaaaggaaccatcagcggattccctgccgtgatcgcgatcatggattcaacattccgaatgggcagcatgggttcggttgtcggcgaaaaaatcacgcttgcaattgaaaaagcaaaagaggaaaaagtcccgtttatcatctttaccgcttccggcggcgcacgtatgcaggaaggggtcttaagtcttatgcaaatggcaaagacaagctctgcattaaaactgttcagtgaggagcagggactgattatttctgtcatgacccacccgacgacaggcggcgtatcggccagtttcgcgtctctcggtgattataatttcgctgaaccgggcgccttgatcggatttgcaggaagacgtattattgaacagacgatcggggaaaaactgccggaagatttccagacggcggaatttttattaaagcacggccagcttgatgcggtgattcaccgaaacgacatgaaagagaaactcgcatttctgctggacatgcaccaaacaggaggtgagcatgagtggctgcaagattagaatttgaaaaaccggtgattgaactgcagacgaaaattgccgaactgaaaaaattcacccaagattcggagatggatttaagcgctgaaatcgcaaggcttgaagaccggctcagcaagctccaggatgagatttataaaaatctgaagccgtgggacagagtgcagatcgcacgccttcccgaccggccgacgacgcttgattacattcaatacctgtttaccgacttttttgagtgtcacggagacagaacatacggagatgatgctgcgattgtcggcggagtcgccaaatatcacggcatgccggtcaccgtcatcggacatcagcgcggaaaagacacgaaagaaaaccttgtccgcaatttcgggatgcctcaccctgagggctaccgcaaagcgcttcgtctcatgaagcaggcggataagttcaaccgcccgattatctgcttcatcgacacgaaaggagcgtacccgggtaaagcggcggaggaacggggacaaagtgaagccatcgccaagaacctgttcgagatggccggcctgacagtgcctgtcgtttgtatcgtcatcggggaaggcggcagcggaggcgcgcttgcgttaggtgtgggcaaccgcatgctgatgcttgagaactcgacgtattccgttatttctcctgaaggagccgcgtccattttgtggaaagactccagccttgcgaaaaaagcggccgaaaccatgaagattactgcgcccgatttattagaattaggaattattgatgatatgattaaagaagtgaagggcggagctcaccatgatatcaagcagcaggcgggctacattgacggtattcttaaagaaacgttaaaatctcttcttcgattgaacgccgaagagttgatctcacagcgctatgaaaaatataaagcaatcgggaaagtttcggttgaggatcaatatatcggggtaaactgaatagacgtgaagcctatggctcacgtttattttttgtgatttttgtgatattccttaaattttatttaaaaacaatttatttaattgtataataggtaaggtttcatgggagctcaggcgtcccttttcattgttttagggcaatgatcatgatatgtttaacatatatagttgctgaggtgaataggaaatgaagcgtataggagttttaacgagcggcggggattccccgggtatgaacgctgcggtgcgcgcggttgtgcggaaagctatctaccacgacgtcgaagtgtacggaatttataacggttattcaggattaatcagcggaaaaatagaaaaactggagctgggttcggtcggtgacatcatccaccgcggcggaacaaagctgtatacggccagatgtcctgaattcaaaacagttgaaggccgtgaaaaaggaatcgaaaatttaaagaaactcggcattgaaggtcttgtcgtcatcggcggagacggttcatacatgggtgcgaaaaaattaacggaacacgggtttccgtgtgtaggtgtaccgggtacgatagataatgacatcccgggaactgattttacgatcggatttgatacggcgttaaacaccgtaattgatgcgattgataaaatccgtgacaccgctacgtctcatgagcgtacatacgttattgaagtgatggggcgccatgcgggcgacattgctttatgggcaggtcttgcaggcggagcggaatcaatcttaattcctgaagcggactacgatatggaggaaattatcggccgtttgaagagagggcacgaccgcggcaaaaaacacagtatcatcatcgttgcagaaggggtaggcagcggggttgaattcggaaaacgcatcgaagaagaaacgaaccttgaaacacgggtatccgttttagggcacatccagcgcggcggatctccaagcgcttctgaccgggttcttgcaagccgcctcggcgcttacgcggttgagcttctgcttaaaggaaaaggcggacgctgcgtaggtatacaaaacaacaagcttgtagaccatgatattatagaaattttagaatcaaaacatactgttgaaccaaacatgtatcagctttcaaaagaactgtctatttaaggcggaagaagctgaagatttcagaaggaagtgaacgagttgaaaaaaacaaaaatcgtttgtacaatcggtccggccagtgaaagtgtagaaatgctgacaaaattgatggaagcgggtatgaacgttgctcgtctgaatttttcacacggtgatttcgaagagcacggcgcaagaatcaaaaacatcagagaagccagcaaaaagctcggcaaaaacgtggggattctcctcgatacgaaaggtccggaaatccgcacgcacgatatggaaaacggcgcgcttgagcttcaggcgggaaatgaaattatcgtttctacgaaacaggtgctgggaacgcttgaaaaattctcagtttcttatgaaggcctggcagacgacgtgtcagcagggtctatcatcctgctggatgacggtttaatcggattggaagtgctggaatcaaatccggaaaaacacgaaatcaaaacaaaaatcttaaacagcggcacgctgaaaaataaaaaaggcgtaaacgttcccggcgtcagcgtcaaccttcccggaattactgaaaaagacgccaaagacatcatattcggtatcgagcaaggcgttgatttcatcgctgcgtcatttgtacgccgttctacggatgtcctggaaatccgcgaactgcttgaagagcataacgcgtctgacattcaaatcattcctaagatcgagaaccaggaaggcgtggacaacctggatgcgatcctggaagtatctgacggcctaatggtagcgcgcggagacctcggcgtagagattccggccgaagaagtgccgctcgtgcaaaaagaaatgatcaaaaaatgcaacgcgctgggcaaaccggttattactgcgacacaaatgctagacagcatgcagcgcaaccctcgtccgacacgtgctgaagcaagtgacgttgccaacgccattttcgacggcacagatgcgatcatgctttccggtgagacggctgcgggacaatatcctgttgaggcggttcaaacaatgtttaacatcgccacacgcacggaagaatctctgaactataaagaaattctgtctaaacgcagagatcaggtcggcatgacgattactgatgcgatcggccaatcagttgcgcacacggcgatcaatctgagtgcggcagctatcgtgacgcctacagaaagcggccatacggcgcgtatgatcgcgaaataccgtccgcaggctccgattgtagccgttacggttaatgagtctgtatcacgcaaactcggccttgtattcggtgtattcccgtcaagcggccaaaacgcgaattctacagatgaaatgcttgaagacgcggttcaaaaatcacttgacagcggcatcgtgaaacgcggtgatctgattgtcattacagcaggttctgtcggtgaatcaggcacgacgaatctgatgaaagtccacactgtcggcagcattatcgcgaaagggcaaggcatcggacgcaaatctgcattcggtccggtcgttgttgcaaaaaatgcgaaagaagctgaacaaaaaatgacagacggcgcagtattggttgcttcaagcactgaccgcgacatgatcgcttcacttgaaaaagcatcagcgctcatcactgaagaaggcggtctgacaagccatgcagccgttgtcggtttaagcttgggcattccggttatcgtcggccttgagaacgcaacttcagttttaacagaaggacaggttatcacagttgacgctgcccgcggcgctgtgtatgaaggccgcgcaagcgttctttaaacagctttaaaaaagagaggggggttctcccttctcttttgtctttaggttgattttcctattcccatgcgggcggtgacgcgcttttagaagggcaggagggcagaaaaatgagagtgttattcttactgtttatcgtatgtccggcaattgaaatcggtttgtttctgctggcgggaaaatggctcggtatttttccgaccttccttctcatcattttgacaggcgtgttaggcgctttggtggcaaaaagacagggaaccgatgtgtatcatcgggtgatgcgcgacctgcagcacggcaaaatgccgggggaagcgcttcttgacggaatatgcgtctttttcggaggcctgcttttgatgcttccgggttttctgtccgatattgcaggggcctgtcttctgattccgttcactcggaaccgcatgaagccgtttttgttcaaatggctgagagggatgtcaaaaaacaagcggatcattatcaaataaaaaacggcagccttcttacagggctgctgtttttatttggattgaacagtaatataggcccatatttcttttagagcgcccgttgtgataaaggcctgaatgaaaacgagcagcgcgggcccggcagccagtcctaaaattccgaacaatttaaagccggcaaacagggcgattaaggtcgcaagcggatcaagtccgattgacttgcttaaaattttcggctccgtcagctggcgctgaatgagaaccacaatatataaaacaccgagaccgatcgcttgaggaagctgaccggcaatggccaaatacataatccagggaacaaagaccgacccggcgccgagatacgggagcagatcaaccaggccgataaaaaaggcgatggttgccgcatgctcaatccctaaaagaaaaagtccgataaagacaatgatcatcgtgaaaagtatgagcacggcctgcgccttaatgaaacctgccatcgcttttttcagctctcccgatacggccttggcgtttgccgaaacccgttccggaaaaatggaataaagcagcgccttcagcttatgccagtcctttgtcataaaaaaagtcgccagcattgcgaaaatgaagacggcagctgtattgggaaggaaggcaatccatttcggcaccagctccaaaagatgtgaaagcatgagccccgcatttttagcggctgtatcaccgagggtctgaatatgcgtcacgatggaagcctgctgattggtttccagcccgttaaataggacggtcagctcgtggtacaatggctgaatgcgggaagtgaacagctcttcgcaatacgtcataaaggcgctgatatggggagggagcgttttggccagataggcggttcccgaaatgatttccgcaacgagaaatgttgccgcgccgagaagaataagcaaaaagaagaccaggacaatgactgtattgactgaccggggcagccccgtcagtttgtccagccagtcaacaacgggaatgatcgctgatgacagaataagggcgatcagaaacggataagttaacggaaatgaggcgtaaccggccgctaaagcgccgccggccgcagcgagtacaaacagcgcgcggaaaaaaacagttgcatagtgcggattcacatcgatcctcctctcggtcggcacgtcctattacattagtttattcgtcaaaaaaaaggatatgattacagatatgatgaaagagggtgctttcaggatgtttacacaggcgaatttatttttactattattgctggccatcgcattggtagccaaaaatcagtcattgctttttgccgtcggctttctcattgtgataaaagctgtcggtcttgatcagaaactatttccggttattcagtcaaaaggcatcaactggggggtcaccgtcattacaatcgccgttttagtgccgattgccacaggtgatatcggttttaaacagctcggagaagcgatgaaatcatattatgcgtggatcgctctcggtgccgggatcgcggttgccttaatcgccaaaaacggtctcaccttattggaaaacgaccctcatattacaacggcgctggtcatcggcacgatacttgccgtcgcgcttttcggaggcgtcgccgtcggcccgttaatcggcgccggaatcgcctacttggccatgcaaatcgttaaaatattcacttcataaagtaaaaaagcggcgtaaagctgcttttttttgcgggtgaaaataagagtttgcagggcattttgtagttcagacaaatgccatttgcattattccgaggaatgaagtggcttaccatgtaacaaagaacttcggaatcgccggcgcatattgtgcgatgacagcggatgcagtaaggcggttccaattgatgaatggattaaaagctgatggaatttatgcacttgaaccaaatcaaaacttgaagtgttgttaaaataagcggagaccctttccttcaatttgaaagtttgttaaatttataatgagaatgaaaaaacacaattcggttggtagtccggatgcattatttaaaatgtcagtaaccttcccctcctcgggatgtccatcattcttcagtaaatttaggaggagggaatcgttatgaaattaacggtttactacgatggtcagttttgggtaggagtcattgaagttgtgaatgatgggaaattaagagcagttcgtcatttgtttggaaaagagcccaaggattcagaaatcatgcattttgttcataatcaacttttacagactctctcccgcactgaacaaacaggggtttgtgttaaagcaaaatctaagaagttaaacccaaaaagattacaacggcaagcttctaaagagatgaaaaatatcgggatatcaactaaggcgcaaaaagcgataaaacaggagcttgaagcaagaaaagaaaagaaaaaacaactgaacagaaaacaaagagaaaaaataaaggaacaaaaatatttaatcagaaaacaaaaagcaaaagaaaagcataggggcaaatagttggagaacccgaagcccttcgattaaaaagttgagcggcatcagttttttcttcggactgatttagaaaaaagaagcagaaatcgagcccttctcgagatgaggagggtttttctgcatttatttaacttcacctacatcagtaaatgagtcagtttcaattgatgaacggtttgatgaggatatttacgggccgacaacagcgcaaatgcagtcaaacgattccagtccatgtacggggagccaactaaaaccaagacatggatttccgaagctgatccgaacattgattcagtcgagtaaacaaaatccccccttctccggtaaagaaggagggatttgcggtgaagttgttgcgcctgtccttttaaagtttccccaaagctccccccaaatgaaaacatgagaatacatggttttacaaagcatctgaaagcaagcgattaaatttatcaacgccaagccttgatatatagggcttttaaaacatttttagttaaaagtctacaaattaatcagattattgtttataataagaataggcttaaacttaaataagcttataagaatttgttatgttcctctataagcataccggttatgtaaccgcaaccagtgaaatgtaagcattttcttaaaggggaaagggattgtttgcatgactcattttaagtaagccgtatgttttatatactctttaaaggggaattttgattgaaaaggagaggttgaatatgacagcaacacgcggtcttgaaggggttgtagcaacaacatcatctgtaagctctattatcgacgatacccttacatatgtagggtacgatattgacgacttgacagagaatgcaagttttgaagaaatcatttatttgctgtggcatctgcgcctgccgaataaaacggaacttgctgaactgaaaaaacagcttgcgaaagaagctgccgttccacaagaaatcattgagcacttcaaatcctatcccctcaataacgtacatccaatggctgcgctccggacggcgatttcattactcggtctgactgacagtgaagccgatgtcatgaatccggaagcgaactacagaaaagccatccgtctgcaggcgaaagtgccgggcattgtcgccgctttctcaagaatccgcaaaggacttgatcctgttgaaccgaaggaagagtacggaatcgcggagaacttcctttacaccttaaacggtgaagagccttctccgatcgaagtggaagcgtttaacaaagcgctcattcttcatgcggatcatgagctgaatgcatcaacatttacggcgagagtatgtgtcgccaccttatctgatatttactcaggcatcactgccgcaatcggcgctttaaaaggaccgcttcacggcggagccaatgaagccgtcatgaaaatgctgacagaaatcggcgaagtggaaaacgccgagccttatatccgcagcaaaatggagaaaaaggaaaaagtaatgggcttcggacaccgtgtgtataagcatggagacccgcgcgccaaacacttaaaagaaatgagcaaacgcctgacgaatctgacgggtgaaagcaaatggtacgagatgtcaatccgtgtcgaagaaatcgtgacgtcggagaaaaaacttccgcctaacgttgatttctattccgcatctgtctaccacagtctcggcattgatcacgatctgttcacgccgatctttgcggtcagcagaatgtcaggatggatcgcccatattcttgaacaatacgataacaaccgcctcatccgcccgcgcgctgattacacgggtccggataagcagacttttgttccgcttgatgaaagagcctgatcaaacgggaggctggtgattttcatgtcgttagcctcttgttaatcaagcccggattggtttacaattttgatagaatcttgagaaaagtcattttattttttatacaagaaaaataaaatgttttctaaatatgaattacatactgggaggtaatattgtgtcacaaggtgaaaaaattacagtctctaatggagtattaaacgtaccaaataatccgattatcccgtttattgaaggcgacggcacaggccctgatatttggaatgccgcttctaaagtattggaagccgctgttgaaaaagcatataaaggcgagaaaaaaatcacgtggaaagaagtttatgccggtgaaaaggcttataataaaacaggtgagtggcttcctgccgaaacactggaagacatcagagagtacttcatcgccatcaaaggtcctctgacgacgccggtcggcggcggtatccgttctctgaacgtggcgctgagacaggagcttgatttgtttacgtgcctgcgccctgtcagatatttcacgggagtgccttctccggtcaaacgtcctgaagatacggatatggtcattttccgcgagaatacggaagatatttacgccggaattgagtatgcgaaaggttctgaagaagttgaaaagctgatcagcttcctgcaaaatgaaatgggcgttaacaaaatccgtttccctgaaacgtcaggaatcgggatcaagcctgtttctgaagaaggcacaagccgcttagtcagagctgccattgagtatgcgatcgaaaacggccgtaagtctgtcacgcttgtccacaaaggaaacattatgaagttcactgaaggggcatttaaaaactggggctacgagcttgccgaaagagaatacggagataaagtattcacttgggctgaatatgaccgcattgtcgaaaaagacggaaaagaagcggctgataaagcgcagagcgaagcggaagcggcaggaaaaatcatcgtcaaagacagcatcgctgatattttccttcagcagatcttgacccgtccgagcgaattcgacgtcgtggcgacaatgaacttaaacggagactatatctctgatgcgcttgccgctcaggtaggcggaatcggaatcgcgccgggagcgaacatcaactatgaaacagggcatgcgattttcgaagcgactcacggaacggctcctaaatatgccggccttgacaaggtcaacccgtcatccgtcatcctttcaggagtgcttcttcttgaacacctgaactggaatgaggctgctgacttgatcattaaatctatggaaaaaacgattgcttcaaaagtagtaacgtacgattttgctagattaatggacggtgcaactgaagtgaaatgttcagagttcggtgaagagctcatcaaaaacatggactgaacctaaagcagacttctaatgaagccaaaaaaggagaagagaatcatgggaaaaacacgcagtaaagtttctgttatcggagcaggatttacgggagcgacaacagcctttcttacagctcaaaaagagcttgcggacgttgtgctcgttgatattccgcaattagaaaacccgacaaaaggaaaagcgctagacatgctcgaagcaagtccggttcaaggatttgacgcgaaaatcacaggcacgtccaactacgaggacacagccggttctgatatcgtcgtcatcacagccggaattgcgagaaaaccaggcatgagccgtgatgatctcgtatctacaaacgaaaaaatcatgagaagcgtcacacgtgagatcgtgaaatattctcctgactgcattatcgttgtattgacaaaccctgttgatgcgatgacatatgcggtgtacaaagaatcaggcttcccgaaagaacgcgtcatcggacaatccggagtgcttgacactgcgcgattcagaacattcgtcgctgaagaattaaacctgtctgtaaaagatgtgaccggttttgttcttggcggacacggtgacgacatggttcctctcgtccgttattcctatgcgggcggcattccgcttgaaacgcttatcccgaaagaccgtcttgatgcgattgtagaacgcacaagaaaaggcggcggggaaatcgtcaaccttctcggaaacggaagcgcctactacgcgcctgctgcatcactgactgaaatggtagaagccattttgaaagatcagcgccgcgtgcttccgaccatcgcttacttagaaggcgaatacggtcatgaaggcatttacttaggcgtaccgacgattatcggaggaaacggcctggagcaaatcatcgagcttgaactgacagactatgaaaaagcgcagctgagtaaatcagttgaatctgtcaaaaacgtgatgaaagtattgtcataagaaaaaagggaaggcttccgaatcagaagccttcctctttttacaattaatgaaagcgttttctttttccctgagcgatcctttctctgaaaatgatcaaaaaggcgaattgtctgaacgggcagtattggataaaatgaaatcataaagtgatatgcagcacataaaatagagaaaattggatgtcggggaaaatagacagcggagggcgcagcatgaacaaaaaaattttagttgtagatgatgaacaatctatcgttactcttttacagtataatctggaacggtccggctatgatgtcataaccgcatcagacggcgaagaggctctggagctggcagagaatgaaaatccggatttaatcgtactggatgtcatgctgccgaaagtggacggaatcgacgtctgtaaacagctcagacagcagaaaatgatggttccgatcttgatgctgacagcaaaagatgaggaatttgataaggtgctgggactggagctcggagcggatgattacatgacaaagccgttcagtccgcgggaagtcactgcgcgggtgaaagccattttaagaagggctgacatttcttcgctgtcacaaggcagagaagaggaaaaggacgggcagatcctcatcggcgagctgaaaattcttccggagcattacgaagcgtacttcaagtcagaacagctggaattgacgcctaaagaatttgaactgcttctgtatttgggaaaacacaagggaagagtgctgacgagagatcttctgctgagcgcggtctggaactatgattttgccggggatacccggattgttgacgttcatatcagccatctgcgcgacaaaatcgaatcaaataccaaaaaacccatctatattaaaacaatcagaggtttggggtataaactggaggagccaaaaatgaatgaataaagtccgtgtgcgtctgttcgctttactcgttgtatgtatcatattggttttcagtgttctcggcctttttttacagcagcttatttcttcatccgctgaagaaagaacggcggatcagctgaaaaaggaatcggtatacatagcgggccttcttgacaccggccgaatcggcaataaaagcaatgaaacggtaatccgtgacgccggccgcaccctcggtataaacgtctccttgctcaacgagaagggtgacgccgtatatcattccggcagtcgtgctgatgattcagccgtaaaggagttcatttctcacaataaaagcgaggaagccgtacagtcgaaaagcagagtcatccgcggcactgccgtaaaaaatgacgcagggaaaattgcggggtatgtactcgtttcctcggatatcaacggcggttcaagcgttaccggagaaatgtggggcatgctggcagcaagtctttgtaccgcttttatcattatcgttttcttttatacaaacatgacgtcgcgttacaaaaaatcaatcgacgccgcgacaaaggtggcgacggagctgtccaaagggaattacgacgcccgctcctacagcggttacgcaaggcggtcggaccgtctcgggcgtgcgatgaacagcctggcggtcgatttaatggaaatgacaagaacgcaggatatgcagcgcgatcgtctgttaaccgtcattgaaaatatcggatccggtttgattttaatagacgggagaggttttatcaatctcgtgaaccggtcatacacgaagcagtttcatacaaagcctgaacgtctgcttcggcgcctttaccacgatgcgtttgaacatgaggagatcattcggcttgtcgaagacatttttatgacggagacgaaaaaatgccagctgctcagacttcccatcaacattgagcggcgctactttgaagttgacggcgttccgatcatgggccctgatgatgaatggaagggcatcgtcctcgtttttcacgatatgacggaaattaaaaaattggagcagatgagaaaggacttcgtcgccaatgtctcccatgaactgaaaacaccgatcacctcgattaaaggatttacggaaacactgttagacggagcgatgaaagacgaaaaggcgctttcagactttctgtctatcattctgaaagaaagtgagcggctccaatctctcgtgcaggatttattggatttatccaagatggagcagcaaaactttacgatgcgcgtagagtcctttgatgctgcaaaaattctgcatgaaattgaggcgcttttgcagcataaggctgaggaaaaaggcatcagctttcagctcgatctcccggaagagccgatttttgtgacgggtgatgcgcacaggctgaagcaggtatttttgaatctggcgaacaatgccctgacctacacgcctgaaaaagggacggtggggatttcggtacatgtgaaagaaaccgttgtcgatatcaaagtgtccgatacgggaatcggcattcagaaagaagagatcccgcggatatttgagagattctaccgcgtggataaagacagaagccgcaactcgggaggaaccggcctcggcctcgccattgtgaagcacttaatagaagcccatgaaggtaaaatcgaggtcacaagcgagcctggacagggaactgtgttcactgtgacgctgaagcggccgccggcagcgtgatcagctttacaaaggattaacaatttcttcatgacctgttaaacctatcttgttaggatataacagaaccccttcatccaaggagccaattttgacggcgggaacgcgttttcttgttcccgtccttttttgcgttttcacggggtccgctcattttcctttcaaattgaactttgttaaaataagagaagctgtgagattaaaaaacagaggaatgacgagcttttgctcttaggaggatattgaatgacggaacgaaaaaaattagtgcttgtcgacggaaacagtctggcgtaccgggcgttttttgcattgccgcttttaagcaatgaaaaaggcattcatacaaatgccgtatacgggtttgcgatgattttaatgaaaatgctggaagatgaaaaaccgacccatatgctggtggcttttgatgcgggaaaaaccactttccgccacagcacgtttaaagaatataaaggcggaagacaaaaaacgccgccggagctttcagaacagatgccgttcatccgcgagctcctcgatgcctacaacatcagccgctacgagcttcctgaatatgaagcggacgatattatcggcacgcttgccgtatctgctgaaaaagacggctttgaagtgaaggtcgtttcgggggacaaggacttaacccagcttgcaaccgggaaaacgaccgttgccattacgagaaaaggcattaccgacgtagaagattacacgccggagcacgtgcgggaaaagtacggtctgactcctttgcaaatcattgatatgaagggattaatgggagattcatccgataacataccgggcgtccccggcgtcggagaaaaaaccgcgattaagctcttaaagcagttccattcggttgagaaactgcttgattccattgatgaagtcagcggaaaaaaattaaaagaaaagcttgaagaatataaggaacaagccctgatgagcaaagagctggcgacgattatgacaaatgcgccgattgaagtcaagcccgaagatttagattaccaagggtttgaccgtgaacaagttgttgccatttttaaagacctcggttttaatacgcttcttgagcggctcggtgaagaaagcggggaaacggcggaagaaaattttgaagacatcaatgtcgaaacagcagaagaaatcaccgaagatatgctcgtttcgccgtccgctttggtcgtcgaacaaatcggtgataactatcacgaagaaccgatcctcggcttttccatcgtgaatgaaacaggtctttattatattccgaaagaaatcgccattcagtctgaagcttttaaatcttgggctgaagatgaatcgatgaaaaagtgggtgttcgacagcaaacgttccgtcgtcgctttgcgctggcagggaattgagctgaagggaacggaatttgacgcgcttcttgctgcctacattataaacccgggcaattcgtacgacgatgtcgcgagcgtagcgaaagaatacgggctgaatatcgtttcaaaagatgaagcggtatacggaaaaggcgcaaaacgcgccgttcccgctgaaaaagagcttgccgatcatctcgcgcggaaagcgtctgccgttaacagcctccgtgacaaactgcttgacgctttggaagaaaataatcagcttgagctttatgaagatcttgaactcccgcttgcgctaattctcggagaaatggaatcaatgggcgtcaaagtggatgtggaaagactgaagcgaatgggagaagagctcaaggcaaaactgaaagaatatgaagaaaaaatccatgacatcgccggtgagccgtttaacatcaattcaccaaaacagctcggcgtcattctgtttgaaaaactcggcctgccgccagtaaagaaaacaaaaacaggctattccacttcagctgatgtgcttgagaagctcgcagacaaacatgatatcgtcgcgtacattctgcaatacagacaaatcggcaaactccaatcgacttatattgaagggctgctgaaagtcacgcgcaagggttctcataaggtgcatacacgattcaatcaggcattgactcaaaccggacgcctcagctcaacggatccgaacctgcagaatattccgatccggctggaggaagggcggaaaatccgtcaggctttcgtaccgtccgaaccggactggcttattttcgccgccgattattcacaaattgaattaagggtgcttgcgcatatttcaaaagatgaaaatctgatcgaagcgtttacgaatgatatggacattcacacaaaaaccgccatggacgtgtttcatgtcagtgaagatgaagtgacacaagcgatgcgccgccaggcaaaggccgtcaatttcggcatcgtttacggcatcagtgattacgggctgtcgcaaaacctcggcatcacccggaaagaagcgggcgcttttattgaccgctatttggagagcttcccgggcgtcaaggcgtatatggaagaatcggtgcaggaagcgaaacaaaaaggatatgtgacgacacttatgcagcgccgccgctatatccctgagctgaccagccgcaacttcaacctgcggagctttgcggaacggacggccatgaatacgccgattcagggaagcgccgccgatattattaaaaaagccatgattgacatggcagctgagctgaaagaaaaaaacctgaaggcgcgactgttgcttcaggtgcacgatgaattaatttttgaagcgcctaaggaagaaattgaaatattagagaagctggttcctgaagtgatggagcatgctttggcattagacgtgccgctgaaggcggattatgcttcagggccgtcttggtacgatgcaaaataaacagaaaaaaaggaagtgatgattgtgccggaattaccagaagttgaaacggtccggcgcactctgaccggtcttgtgaaggggaaaacgattgaatcggcggatatcagatggccgaatatcatcaaaaaacccgccgagccggaggaattcgcgcggcagattgcaggagaaacgatccgatccatcggaagaaggggaaagtttttgcttttccatttggatcattatgtcatggtgtcacacctgcgtatggaggggaaatacggtcttcatcaggccgatgagcctgacgataaacatgtgcacgtcgtgtttcacatgacggacggaacacagctccgctaccgggatgtccggaaattcggcacgatgcatttgtttgcgccgggagaggaacggaatgcattaccgctttcacagctcgggcccgaacccgatgatgaagcatttaccgccgcttatttaaaagagcggcttgcaaaaacgaaccgcgcggtaaaaaccgccctgctcgaccaaaaagcggtcgtcggcctcggcaatatttatgtcgatgaagctttattccgggcgcgtattcatcctgaaacaaaagcgaacagtctgtcggacgggcagataaaaacgcttcatacagaaattaaagacacccttcaggaagcgattgacgcgggcgggagcaccgtccggtcttatatcaattctcaaggggagatcggaatgtttcagctcaaacattacgtctacggcaaaaaggatgaaccgtgcaaaacgtgcggcacgatgatttctaaaatcgtggtcggcgggaggggcactcatttttgcgcccgctgccaaaaaaaatcataaactgaagctgttcaagcaggcggcagcagaatgacttttttctaacacagttgatgacctttctccatatatatattgtgattcacccaataggcatatgtcacaattgccgatcaagagaaagggagaaacggatatggagattgtttctttgctgcttttggcttttgctgtcagcttggacagtttttcagtcgggtttacgtacggtttgagaaaaatgaaaatcccgttcaaagcgattgccgtgatcgcctgctgttcagcctctgtgatgtttatatccatgctgatcggccattttctgacaaagatttttcctgtatccgtcacggagaaactgggcgggctgatcttaatcggaataggggcatgggtcatctggcaattttttaaaccggctaaagagccggattacttattgcatgaaaaaacgctgcttaatcttgaagtgaaatcgctcggcatcgtcattcatattttgaaaaaaccgaccagcgccgatattgatcaatccggaaccattaacggagtcgaggcgcttctgctcggtatcgccttatccattgacgcgtttggcgccgggctgggagcggccattctcggcttttctccggttatgatgagcgtgactgtcggggtgatgagctcgctgtttgtttcactcggcataaacgcggggcatttgctttcaaggtggaattggatagataaaatgacatttttgccgggagtcctgctgattatcatcgggatttggaaaatgtaagaaggagtgggctttttgagcttggtcatcggtttaacgggaggcatcgcaagcggcaaaagcacggtagcgcgtatgctgatcgacaaaaaaataacagtcattgatgcggatgtcatcgcgaaacaggcggtggaaaaaggaatgccggcttacggacaaattgtggaagcattcggaaaagacatcctgctggaaaatggcgatattgacagaaaaaaactcggttctatcgttttcactgacgaacagaagcgtctgaagctgaatcagatcgttcatccggcagtgcgtgcggaaatgctgaaacagcgggatgaagccattgcgagaaaagagcagttcgtcgttttggatataccgcttttgtatgaaagcgggcttgattatcttgtcggcaaagtgctcgtcgtcaccgtaccggcagacattcagctcaaacggctgatggagcggaattccctgacagaagaagaagcgatgagccggataacgtcgcaaatgcctttagcggacaaagcaaaaaaagctgacgccgtcattgataacagcggcagtcttgaatatacaaagcaccagcttgaggaagtattgagcggctgggcataaacaaacaccgttcggaaagccgaacggtgtttttctggttaaaaatcaaaattgtcagggtccggaccgacacggagattttcgttcagatcatcaatccgcttcatatcttcagctgacagttcgaaatcaaagacatttgcattttcttcaatacggtgttttttagttgatttcggaatggtgatgacaccgttttgcaaatcccagcgcaaaatcacttgagcggctgatttgccgtatttctcagcaatctcctgtaatacggggtgatcaagcagctgcccttgcatcaatggcgaccacgcttcaagctgaatgccttgttcagtgcagaaagcaagcagttctttctgtgtcaggcgcgggtggtactccacctggttgatcatcggcttgatttccgtttctttcatgagatgtttcaggtggtgaatttggaaattgctgaccccgatcgccttaatgcgtccatcccggtagagggtttcgagcgcccgccacgcatcgatgtactttccttcgacaggccaatggatcaaatataaatctaaataatctaaaccgagtttttctaagcttgtgtcaaacgcttttaacgtttcttcatatcctaaatcggcattccatacttttgacgtgacaaaaatgtcttcacgttttaatcccgcttcttgcagcccttggcggatcccttcgccgacaccttcttcatttccgtaaatcgcggcggtatcaacgctgcgatagccgtgcaccaatgccgttttcaccgcgttgacgagttccgcgccttcctctactttgaaaactccgatgccgaaccaaggcatctctactccgttatgcaatgttgcttttgcttgtaaatgtgttgtcatgtatatattcctcctattatttgtctgtcgaaaaaaatcaaaatgcgctgaagaaaaactcacctcctttcaagggcagtgcgatcccgcttttccagcttcctgctccatccggttaatacgaccgcgctgagcaccatcagcgccccgatccaagcggtatgaatgattccgattgagtctgtaatgattccgccggcaaacgagccgatcgcgattccggcattaaatgccgcgatatttaaggctgatgctgtatcaacggcgcttggcgcaaaacgttcactcagcatcacgacatatacctgaagccccggcacattcataaacgccaacagccccatgaaaataatggtgatcagcccggctgttttaaacggcgcggtaaaagtcaggacaaacagcacagctgcctggacaatgaacatataaaacaaggctttcagcggattccggtttgataaacggccgccaatcatgtttccgatggcaatcgcaattccgtaaatgagcaggatggccgcgacggtttctttctgaaaacccgttacctcctgaagaagcggagataaatacgtaaacacgacaaacgttccgccgtagcctaacgctgtaataataaataaaagcaataaccggccgtttgtgacgagtttgacctgctcggaaaatgcggttttcgtccctttgcgcaaatgagacggaacgagaagcgcgtttgtgaggaatgcgatgattcctaccgccacaatcacggcaaatgcgattctccatccgaattgctggccgagataggtgccgaacggaacgccggtcaccgtagccaccgtcagccccgtgaacataatggaaatcgcgcttgctcttttatgctccggcacgatattggcggcgatcgttgccccgattgacatgaaaatgccgtgggaaaaagccgaaatgacccgtgccgccagtaagacgccgattgaggaagcgctcgctgcgagtgtatttccggcgataaaaatcaacatcacccagagcagcagtgttttccgcgacatgccggatgtgagagacgttaaaaccggcgcgccgaatgtcacgcccagagcatacatggaaacggtaagtcccgccgttgtcacaggtatatgcagatcttgagatataagcggcagcagtccgacgctgataaattcggttgtgccgatcgcaaaagcgctgacggctaatgccagcagcgctggtaaatagctttggcgatgtgaagacatctgttttcctccttaaacgataatgtatggttgaaatgatgccgggtaaacgatataagtataagagtacattccttttcagccggcaaatgtcattatgattgatagaagtgtcattgaaaagaacgtacttttaagtgccataggcactttttagttcctatagatgaggaggaattaccgttgctgaagaaaaaatacaatatatccgtagaggcggcgcttgaagtgatcggcggaaaatggaagtgtgtgatcctctgccacctcatgcgcgggaaaaaacggacaagcgaattgaagcggcttatgccggacatcacccagaagatgctgacacagcaattgcgggagctggaagctgacggcgtcatcaaccggatcgtgtacaatcaggtgccgccgaaagtggaatacgagctgagtgaatacgggcacagtctggaaagaattttaaatgcgctgtgtgactggggcgcgatgcatattgctaaacggtacggcgaggtgtcttccgttttagaggacagcattttgaatgacaaatttaaagaaccgggacaaatataagaaaaaagcaggcagcctgagacgctgatcctgctttttttatggaagaaaaatcattttatatgcaaaaaaaccgattgaacaacatattgatcggtataagggtggatttttatcaagttgtactggcggatttcttttaatgtgttatactatatataaataaaggtaaattagagtggcatattaaaaaggggtgacctgagcatgaaggtaaaagtagcaataaacgggtttggaagaatcggaagaatggtgttcagaaaagcaatggaagatgatcaaattcaaataacagccattaatgcaagctatcccccggaaacgcttgctcatttgataaagtatgacacaattcacggcaaataccatcaagaagttgagaccgccgacgacagcctgatcgtcaacggaaaacatattatgctgttcaatcgccgggacccgagagagcttccgtggaaagaatgcggaatagacatcgtcgtagaggcaacggggaaatttaattcaaaagaaaaagcgatgagccatattgaagcaggggcgaaaaaagtcattttaacggctccgggcaaaaatgaagacgttaccattgtcatgggagtaaatgaagagcagttcaatcccgatgaacatgtcattatttcaaatgcatcctgcacgacaaactgtcttgcgccggtcgtcaaagtgcttgatcaggaattcgggattgaaagcgggctgatgacgactgttcacgcttacacgaatgatcaaaaaaatatcgacaatccgcataaagatctgcggagggcgagagcgtgcggagaatccatcattccgacttctacaggcgccgctaaagcgctgtcgctcgtgctgcctcatttgaaaggaaaacttcacggtctcgctttgcgtgttcccgttccgaatgtgtcattagtggaccttgtctgcgatctgaaaacagatgtgtcggccgagcaagtgaacgccgctttccaaagagcctcaaaaacgtcgatgtacggaattcttgattattcggatgagccgctcgtttcttcggattataatacgaattcacactctgcgatcatcgacggactgacaacgatggtgatggaagaccgaaaagtaaaggtgctcgcctggtatgacaatgaatggggatattcctgccgggtcgttgatcttatccgtcacgtcgccgcgcgaatgaaacacccgtcagctgtgtagactaaagatcatggacatttgttagaaaaaaacccttaacggcatattcgcaaaaaacacaccttgcaaaataaacttaaacacagtatactatctttcgtgaacttcttgctcgtgactgcttcggaattacttaaagggttaggacctctccggactaactttcccccgtggtaaatggccgggtcagttctcggaaattcacttttttaattcttgttaaggggggtccatgattatggaaacaatggggcgtcacgtcatctccgagctgtggggatgcgattttgataagctcaatgacatggattttattgaaaaaacgtttgtaaatgctgctttgaaatcaggagctgaagtgcgcgaggtcgcatttcacaaatttgcaccgcaaggcgtaagcggagtcgttattatctctgagtcacatttaacgattcacagttttcctgaacacggatatgcaagcattgatgtttatacttgtggagacctggatcctaatgtggctgcggattacattgcggacgcattacatgcagatacaagagaaaacattgaaataccgagaggaatggggcctgtacagattaaacaggcacaagcgaaagtactgtaattttcaaaacgcaaacacaagggagctaagctgaaaaagccattacgcgctttgaagctgatgctccttttctaatgtaaaaaaacagcattgctttttctttaagcattttttttgtaaaatagaaaagataaggccggtctatcggctctcccaacaaataggctcatcctagaaacgttggcgggcatttaccggaagcttgcgaaccgcattacagcaacgaaacagatgggagctgatccaatttgaaatgtccttcatgccagcataacggttcccgcgtacttgattcacggcctgcggacgaagggaaatcaatccgcagaaggcgggaatgcgaagcctgccattaccgcttcactacatttgagaagtttgaagagatgcctctgatcgtcgtgaaaaaagaaggcgtccgggaagaattcagccgtgaaaaaatgctgcgcgggttaattaaagcttgtgaaaaaaggcccgttcctttgaaaacattggaagacatgtgctttgacattgaaaaagagctgagaaaccaaggcgtatctgaagtcaaaagcgaacttgtcggtgaaatggtaatggaccgcctggcgaaaatcgatgaggtgtcttatgtccgctttgcctccgtctaccggcagtttaaggatataaacgtgtttatcgatgaattgaaagatttaataaagaaagaacgctgagagagctaagagattgtgtctggctcttttctcatgagcaaaattggcatttgatagatcgcagaaacggtgtaaaatgagagtagaaacatatcggaaggtttgagaatcatggctgactattggaatgacgtattgcctgtagatccttatacggtcaaaagccgttcgcttcttcaggatgtcgacagacaggttttgacacatctgtaccagccgctgatcggttcttttgcattctccctttatatgaccttatggggggagcttgagcagaaccgcttgtggggagcggaatccacgcacaggcagctgatgggcatgatgcagtcaaatttaaaaaagattcatcatgaacagggaaagcttgaaggaatcggactgctgaaagtgtatatccgggagtccgagcaaaaagagcggatgtttatttatgagctgctgcccccgctcaggccgaatgatttttttgaagacggcatgctgaatgtctttctttataacagagtcggtaaaacgaaataccagcagctgagacaattttacacgcacccttccgtcggcgcgggcgcaagggaaattacccgtccgtttaatcacgcttttgcctcttttcagccgagtgaatggaaaatgacgcctgatatggaagaggcgatgaagctccccgaggactatgagacggcgtctgtcggacaagcgccttcctatacggtgacggaggaagtgtttgattttgagctgtttttggcggggttatcagaaacgatgataccgcgcaaatcaatcacacaggatgtgcgggagagcattaaaaagctttcatatttatacggaatagatcctatctccatgcagcacgtcgtcatgaccgcaattaatgagcaggatacgataacggccgaagcgctgaggaaagcggccagcgactggtaccaaattgaaagaagcggcaagcttcccgaactgattgataaaacacagcctgtcaccttgagagaaaaccggacggaaaaggacgattcattgaacggcgaactcatcgcacagcttgagaccatatcaccgagaaagcttctccaggacattgcggacgggaccgagccgtcaaaagccgacctgcagattatcgccgatattatgttcgaacaaaagcttgagcccggcgtcaccaatgtgctgatttattatgtcatgctgaaaacggatatgaagctgtccaaaaactatatccaaaaaatcgccgcccactgggccagaaagaaagtcaaaacggtacgggaagcaatgaagctcgcaatcgaagagcacaggcaatatcttgattgggcggacggcaaaacaaacggcgcggcgcgcggcaaaaaaaccgtccgggaagaaaagcgccctgattggatgaaagaagaagaaaccgggaagaaacaagaacagacggctctttccgcacaggatcttgaagaacagaagaaaaaaatgatggaagaaatgaaaaaactgaaaaaatactctgcctattgagacagagaagcggggtgatattgaatggaaccgatcagccgatccttagaaggcgtgacgaaaagacctgactttcaaaaacgcctggaacgaatgcagcagcaagttatggccgacgaagacgtccaggcttttttgaaggaacagaaagatgttatcaatcaaagcatgattgacagagggttaaataaactgtacgaattcgttcagcaaagtaaacagtgcgccttctgttcgaaagacagccggacgaacagcctgcttgaaggctaccatccgaagcttgtgatcaacgggcgttccattgatattgaatattacgaatgtccggaaaagagaaagctcgaccgccagaaaaggcaaaagtccctgatgaagagcatgtatatccagcaggatcttctcggcgcgacgtttcagcagatcgacattaccgatccgagcagactcggcattttccagcatgtgacggattttctgaagagctataatgaaacgggaaaaggcaaagggctgtatctgtacggaaaattcggaatcggaaagacatttattttagccgccattgccaatgaactggcggaaaaagagtattcatcaatgatcgtatatgttcccgaatttgtcagagagctgaaaaactcgcttcaggatcagtcgctggaggcgaaactgaatatggtgaaaacgacgcccgtactgatgcttgatgacatcggagcggagtcaatgacaagctgggtcagggatgaagtcatcggcaccgtgcttcagcacagaatgagccagcagcttcccactttcttctcgtctaatttttcaccagacgagctgaagcatcattttacgtattcacagcggggagaaaaggaagaagtaaaagcggcaagactgatggagcggattttatatttggcttcgcccgtccgtcttgacggggaaaaccgccgccgttcatgatgccggcgtccaatgggaaggatttgagggaatgaggaataagaaggctgtcacttgggctgcggctgcggcgggagcgggtcttttgctgtgggcaaaccgcaaatatctgaatctgtcgcctaaggagatccggctgtgggtgttatcgttcggtgtttttgcgccgcttgtgtttatcggaatttccatcgtcaggccttttgtgctgtttcccgtatcaatcgtttccgtcgccggaggattggcgttcggcccgtttttcggcaccatgtatacgctggcgggctcaatgggcgctgccgccgcgtctttttttgcggcggggctgtttgcctttaatgagaaaagccgtcatggaaaaatggaagccattcaaaagcagatgaaaaccaatggcttcttttatatttttatcctgcgcattctgcctgttaactttgatgtgatcagctatgccgcgggcctatcgaaagtcaggccggtaacgtattttttggcgaccgcagcgggcatcattccggggacgatcgtcctgaatgtgctcggcgcgagctttatgtccggcaatgtgctggccgtactctgcgtgatctgtctttacgtcgtatttttatcgcttcccgttatatttaaaaagaaggtgcgtcatttgttcggcggtgaaagctaacctttacgtctattttaaaaacatcccccatatacttgtaacagatgccgtaaggggggacaaatatgcttgaagtgatctttgaagatgaccacgataccgccgcttttttacatctcattcagcaatcggacgaccggagacattttattgtccgtgaaggcataaaaaaagtcggaatcgcaaggtctgaaacggctttttgcgttcagcgctttattgagccgatacttgtcaggttttttttggaatgcaaagaagacgagcatatgctttcgcttattgaggacgcatactgcttcaccgatcaggatgaacagcagcaaatccttcagcttgcacacagcattatggaaggagagcttgaggatcatccgtttgagccgaagaaagagccgcgcacacagtttatttcagatgcgctccgaacgatttcacttgatgcgggtgttttttccgtgcgttcgtttcagacgttccggctcggcaggtattatgagaggctcagagaatatacggaggccgcgatagatgaataccggatggaacaggaatatcaaaactttatccagtctctgagagattatgtgacatccaatccgccgcggatgaagaaagtccgcatcgtacatgaccgggcttttacgctgtgggagctgcgctatgtgtctgaacgggaacagaaaaaatacatagacagacggtttgtgcgggagcacccgatgtatatagattcccatctccttgcgccgctgatctccattgcgcctgagacggtcgaactgtatacggacaaaccggaacatatgatgtcaagaaccattcaaaacgtgtttcaggagagggtgcgcctttttccgctgggcgcgtttgcagccgagaagacggaaggatagccgcacggacggccttgtgtaagcggcagggctgtctgtgcgaaatcagacggaaaaccgagttgcatttttctcacagacattttataatacataaaagattaatgattgctacacgtattgataaggacatgaagcattgataccggctgtataagagaggagagcccaggctgaaagctttccagctatggatcattgtctttaccgcctttgaacttcagctgtgaacgccggaataagcgccagtaatagctgacgggaactcccgttacagagcttagagccgcagtgccgaagcaatcggccgcgcggaaaaaagggtggaaccacgattccgtttatttaacctcgtccctttcatagggggcggggtttttgatttgcataaaaaaaggagtgacgaagatgtcagatatgatcaacatcacatttccggacggagcggtaaaggaatttccgaaaggaactacaacagaagatatcgcggcatccatcagtccgggattaaagaaaaagtctttagccggaaaactgaacggacaggaaattgatttaagaacgccgattcaagaggacggtgccgtagaaatcattacagaaggcacagaagaaggtttgaacatcatgcggcacagcacggcgcatttattggcccaggcgattaaacgcatttataaagatgtgaaattcggagtcggccccgtcattgaaaacgggttctattatgacgttgaaatggagcaggcgctgacgccggatgaccttccgaagattgaaaaagaaatgaaacgcatcatcggtgaaaatctgccgatcatccgaaaagaagtgagccgtgatgaagcaaaagccatgtttgcggaaatcggcgataatctgaagcttgaactgctggatgcgattccagaagacgaaacggtctctatttatgagcagggcgaattttttgacctgtgccgcggcgtgcacgtgccgtctacaggcaaaattaaagaatttaagctgctgagccttgcgggcgcatactggcgcggcgacagcaaaaaccaaatgcttcagcggatttacggcacggctttctttaaaaaggatgacttgaaagagcatttgcgcatgcttgaagaagcgaaagagcgtgaccaccgaaaactgggcaaagaattaaaattgtttgccaactctcaaaaagtcggacaaggtctgccgctctggctgccgaaaggcgcgaccatccgccgcgtgatcgagcgctacattgtggataaagagctgagcctcggttatgagcatgtgtatacgcctgtcctcggaagcaaagacctgtacgaaacatcagggcactgggatcattatcaggatacaatgttccctccgatggaaatggacaatgaaacactcgtgctccgtccgatgaactgtcctcaccatatgatgatttacaaacaggacattcacagctaccgcgagcttccgatccgcatcgccgagctcggaacgatgcatcgttatgaaatgtccggggcgctttcaggtcttcagcgcgtacgcggcatgacgttaaatgacgcgcacattttcgtccgccctgatcagattaaagaagaattcatccgcaccgtccgtttgattcaagacgtatacgaagacttcggactgagtgattacacattccgcctgtcttaccgcgatcctgaagatacggaaaaatattttgatgatgatgagatgtggaacaaagcgcaatccatgctgaaggcggcaatggatgagatggggcacgactattatgaagcggaaggcgaagcggcgttttacggccctaaacttgacgtgcaggtgaaaacggcgatcggcaaagaagagacattgtcaactgtacagcttgacttccttcttccggaacgctttgatctcacttacgtcggagaagacggcaaacagcaccgccctgtcgttattcaccgcggcgtcgtatcaacgatggagcgtttcgttgctttcttaatcgaagagcacaaaggcgcccttccgacatggcttgcgccggtgcaattccaagtcattcctgtatcaccgtccgtgcatcttgactacgcgaaaaaagtgcaggagcgcctgcagcgcgaaggcctgcgtgtcgagcttgacagccgggacgaaaaaatcggctataaaatccgtgaagcgcaaatgcaaaaaatcccgtacatgcttgtggtcggtgaccaagaagcggaaaacggcgcggtaaacgtccggaaatacggcgagcagaaatcagaaaccgtctcattggacgattttgtgaaaaaggctgtagcagaagcgaaaaaataaccggaaatacaaaaaaccccgttcattcagaatggggtttttttgcgtataaaattatctttctttttgtttctctataatcgcaaacagctcgtgaagatcgctgatcacgtaatcaggcgcaatgtccgtatcatttttcttttgtgtccggtttacccagactgtcgtaatgcctgcccgtttcgctcccaatatatcagtattgaggttatctccgaccataatggcgtcttcttttttcaggttcaggaggccgaggcaatgttcgaatatggaggcatcgggtttcccttttccgaaagcgcctgagatgacgatttcattaaaataaggcgcgagctcaggaacgccggctagtttttctttctgcaggctgggatcgccgtttgtcagcagaagcaattcataaacacctttcagcttatcaagcaccgcaaacgtttcatcatacacatacgggcgctgtctgcgttccgccgcgaaaaactccgccaaatattcgccgtaagccgcatcgtctataccgacgctttttaagccgttcgtccaggcgtttcgtctgtattccggcgcaatccgattcagctgtttaaatccttcgctgaccggctcggaaaaattcgcccataatccttcaaacggattaatgccgatcatgaccgtataaggataggtttcgtatgacatatacaattcccgtgccgctttccgtaccgcctcttcaaatgtttgcgggtcaaggccatattttttttccgcttgtaaacatgtttccctgaatgttgttctgacgcttttttcatcccataacagtgtatcgtccaaatcaaaaaatacggctttcatgatcttctcctctttgttatattctgaaactctctgccgcaaggctcccgtttattctacaatagatacatagactgtgaaagatttgttttcagatgatttgaaaaaaacaggcaggtttgtgtcagattctgtctcgggctctaaaacgtgataaaataaaatttgaaagaacaggtgaaaagtatgctgcatttgatcatcatgatgctggaaagagtcggaattatcgtcatattgggatttgttctggctcataccagattgttcagacaggcgctccagcagcctgagagctataaaggcaaagcggtgctgatttcaattttctcgctgttcagtatcatcagcaactatacgggaatagaaattcagcagaatacaatcatgaataatgactgggtgtttcaaattaatccgtccggttcaattgccaatacaagaattatgggcgttgaaatcggcggactcttaggcggcccctatgtggggatcggcgtcggcatactggccggcctgcatcgtttatcactcggcggcgcgaccgcagtcagctgtgccgtctcatccgttttagcgggcattttgtccggctggatcggacggtatttcagaaaacgctacaggatgccgacaccgcgtgtggccgcgcttgtcggactcgggatggaatcgctgcaaatgctgctcatcctcttgatggccaagccgttttctgacgcttggacgcttgtgagcatcatcggcatcccgatgatattggtaaacgggtcagggacttttatttttctttcgatcattcagtcgattatccggaaggaagaacgggcgagagcccttgaaacccacagggtgctgatgattgccgatcagacgcttccgtatttccgccaggggctgaatgaaagctcatgcaaaagcgtcgccgccatcattcacaggcaaacaggaacggacgcggtatcgcttacggataacgaaaagattttggcgcacgtcggcgcgggtgccgaccatcatattccgtctgaaagcctgattaccggattgtcaaagcgcgttattaaaacgggtcatattatgaaagcgacatcaaaggaagaaattgaatgcacgcacgatccctgtccgctgcatgcggcgattgtattgccgctgacgtcaaacggcaaaacgatcgggacgctgaaaatgtactttaaaagcccgtcaggtttaagccgggttgaagaagagcttgcagaaggactcgccatgctgttttccacacagcttgaactcggcgaggcggaactgcagagcaaattgctgaaagacgcagaaataaaagcgcttcaagcacaggtcaatccgcattttctgtttaatgcgatcaatacgatttctgctctttgccgtacggatgtagaaaaaacccgaaagcttctgctgcagctcagcgtctatttccgttccaatctccagggggcaaggcagctgctcatcccgctttctaaagaactgaaccatctgcaggcgtatttatcattggagcaggcccgttttcctgggaaatataaaatcagccttgaaatcgaacgcggtttggaggacatcgaaattcctccttttgtgctgcagattctcgtcgaaaatgcgcttcgccatgcattttcaagaaagcaggacagctgtgccgtcaatgtgagcgtggtatccgccggtcagtcggttttaatgcgggttggagataacgggcggggaattgatccggaattgctgtccgtgctcggaaaccgtccgctcccgtctaaagaagggacgggaaccgcgctttacaatttaaatcagcggctgatcgggctgttcggccccaaggcagccctgcgattggaaagtgaggccggcaaaggtacggacgtatcatttgagctgcctttgaaactgatgactaaaggagaagaacatgctgaaggtgttaatcgttgatgatgaaatgctggcaagagatgaattagcttatttgctgaaacggacgaatgaagtaagtgacataaacgaagctgaaaatattgaatccgcttttgacagtatgatggatcaaaaaccggatctgctgtttttggacgttgatttgtcaggagaaaacggatttgatattgccaaacggctgaaaaacatgaaaaatccgccggccgtcgtttttgcgacggcgtatgaccaatttgctttaaaagcttttgaagtcgacgcactcgattatttaacgaagccttttgatgaagaaagagtgcgccagacgatcagaaagtttaaaagagtgaagcaggacagggcaggagccgtctcggagctgccgtccgcagccggagcgcataaactggctgtatcagccggtgaatctattgtcattttagatacgaaggacattatttacgccggcatggaggacggacacgtttccgtcaaaacgtttgccgcgtcttattccgttcatgaaactttggcggtcattgagaaaaaactgcctgatacgggtttcttgagagtgcaccgcgcgttcatcgtgaatacggagcatattacggaaattcatccgtggtttaattcgacttacaatctgatattaaaagacggttctaaaattcccgtcagccgtacatacgccaaggacttaaaaaagctgcttcatattatatgaggcggcttttgcatttcagcagccgttttttgcatttcagaatgaatattcagccgtttgttatgaaagcgctttaaaaatcgatttctcttttataatggacctaacaaagagaaagaggtgaagaaaatgagtgcgaaaaaagtgtacggatttctgacacaagcatttatttttgccgtagttatgctcatatctaatgggattgcagcgattgtccccattcctatacccgcttccgtagtaggtttggtgttattatttgtcctcttatgcctgaaagtgattaagcttgaacaagtagaaacgctgggaacatcattaacgtcactgatcggatttttatttgtcccgtcgggcatctccgtgatgaattcacttggcgtcatgcagcagtacggcgtgcagatcgcactcgtcatcttactcgccaccatcattctgttaggggcgacaggccttttttctcagctgatcttgtctgtcagccaaaaacgtcagaaggctgctccggctgataaacaaacggtgcgccgttccaatcaggaaaacgaacttgtgcagcattaggagggaaaacggatgagtccatatttcggtattgtcgtttcacttgcggcctttggcatcggcacgtatttatttaaaaaaacgagaggctttttcctcttcaccccgctgtttgttgcgatggtgcttggaattctttttctgaagctcggcggtttttcgtatgaagattataaaagcggaggagacattattaaattcttcctggagcccgcgacgatcgcttttgccatccctttatacaaacagcgtgccaagctgaaaaaatactggtggcagatcatgtcttccatcattgtcggctctatctgctcagtcacgattgtctatttgatcgcaaaaggcattcatctcgacgcggccgttatgaaaagcatgcttccgcaggcggcgacaacggcaattgcccttccgctgtcaaaagggatcggcggcatcaccgacatcaccgctttcgccgttattttcaacgccgttatcgtctatgctcttggcgctttattcttaaaactgtttaaagtaaagcacccaatctctaagggactggctctcggcacatcaggacacgcactcggtgttgcggtcggcattgagatgggggaagtagaagcggcaatggcaagtatcgcggttgtcgtcgtaggagtggtgacggtgctggtcattccggtattcgttcagctcatcggaggataaacccgggtcatagacccgggttttttattgtgttggcacgtccgcgggcggcaaagaacgaaatttcacatttttccttgcgctcaccccggcatcgtgttaaaatgaaaaagttgatccggagaagtcattcttgactaatgatccggtattgtgtagaatagttattgaattgaatataaatcacaagcagaggcacccgcttctcacctgattgacacattcatgtagttggcaggttgaccgtacatttttatttatgcagatgttcgtagtgtgggtgtgttgtcatgcccgcactttttgtttgcctgcagaatgcagtcaaaaagcgttgtgaatcaattcgaagaaactatggaggtggctcattattagcaaagatcaattggttaatgagggtatccgtgcacgtgaagttcgtctgatcggacaaaatggcgatcagctcggcatcaagtcccgtcaggaagcacttgaaatcgccggccgcgcaaatcttgaccttgtgttagttgcagcaaatgcaaaaccgcctgtctgccgcatcatggactacggtaagttccgattcgagcagcagaaaaaggacaaagaagcacgcaaaaatcaaaaaatcattaacttaaaagaagttagattaagtccgacgatcgatgagcatgactttaacacgaaattgcgcaatgcgattaaattccttgaaaaaggcgataaagtgaaagcttctatccgctttaaagggcgcgcaatcactcataaagaaatcggccagcgcgtattggaccgtttctctgaagcatgtgcggaagttgcgacagtcgaaacaaaaccaaaaatggacggccgcagcatgttcttaatgctcgcgccgaaaaacgaaaagcaataaggaggaaatcccatgccaaaaatgaaaactcaccgcggatctgctaaacgttttaaaaagacaggttctgggaagttaaaacgttctcatgcatacacaagtcacttattcgccaacaaatcccaaaagcaaaagcgtaagcttcgcaagggtgctattgtgagcgcaggagacttcaaacgcatcaaacaacagcttgccaacatcaagtaatcggacaaggaacaattaggagggaaatctaatgccaagagtaaaaggcggaactgttacacgtaagcgtcgtaaaaaggttcttaaattagcaaaaggttatttcggttcaaaacatacattatacaaagtagcaaaccagcaggtcatgaaatcaggaaactatgcattccgtgaccgccgtcagaaaaaacgtgatttccgtaagctttggatcactcgtatcaacgctgctgcacgtatgaacggtctttcttacagccgtttaatgcacggtcttaagctttcaggcatcgaagtaaaccgcaaaatgcttgctgatcttgctgtaaacgatcttactgctttcaatcagcttgctgatgctgctaaagctcagttagacaagtaagttgaaaaagccgctctctttccgggagcggtttttttacgtaaagggtgacaatcaatggctctcttcatttacgccgtattgataaacggatacggcttttggatcatgggcgctgataaaagaagagcaaaggcgcacaggtggagaatatcagagaaacgaatatggctcacagccgccatgttcggctcactcggcgtatggatcggcatgcgcaccttcaggcataagacgaagcacaaatcctttttatacggggtgccgctgctttttctcactgaagccgcccttgtgctcatgtatttgatgtataaaaaataaaaagcaggagagcttatcgctcgcctgcttttttcgcttttttgatgggctggtcccaatcaatcttgcaattcggataccgctccaatacctttttttcgacttcttcaaaatcatctgcagaaaagcggttcagcttttccggattttcggtccatacaaatattgtatggataaacagcggatgatctttggaagggatatgcttttctccttcaaagagcactcctttataagtaagctggagattttttcgcgtgtttttctgttcgtcaataaaataaaaattctcttttgattgcgccagtctgagccttcttttcgggtttgcgtaaaatttgacgcacatgtaaataaaataaataagaagtgcaagcaagacaatcctcaatactgtaatggccatatgtgtgaaggcacctcctcacctttgtcatgatctgatgtaatacgaaaaacaaaacaaaaagtttcatttttttaaaagaaatagataaaaacatttacccgtttttcaggcgaattaatcgtatgcttcagcattggttttgtataataagaagggtagtgaaaaaaaggaggtttattgatgacaaaattagatgaaacgctcaccatgctgaaagcgttaacggatgcaaaagggataccgggaaatgagagagaagtaagacaagtgatgaaatcatacatagaaccatttgccgatgatgtcacaacagaccggctgggaagtttaatcgccaaaaaaaccggcaaagaaaacggtccgaaaatcatgatctcagggcatttagacgaagtcggttttatggtgacgcaaatcactgataaaggctttctccgctttcaaaccgtcggcggctggtggtctcaggtcatgctggcccagcgcgtcaccgtcgtgacaaaaaaaggggacatcacggggatcatcggttcgaaaccgcctcacattctgcctcctgacgccagaaaaaaagccgctgatattaaagagatgttcatcgatatcggggcgtccagccgtgaagaagcaatggaatggggcgttcttccgggtgatcagattgtgccgtattttgaatttacagtgatgaacaatgaaaagcatttattggcgaaagcgtgggacaaccgtatcggctgtgcgattgccatcgatgtattaaaaaatctgaaaaacagtgatcacccgaatgaagtatacggggtcggaacggttcaagaagaagtcgggctgcgcggggcgaaaacagcggcacatacgatccagcctgatatcgcgttcggtgtggatgtcggaattgccggagatacaccgggaatttctgaaaaagaggcgcaaagcaaaatcggcgaagggccgcaaattattctgtatgacgcgtcaatggtatctcacaaagggctgcgcgaccttgtcgtaaacacggcggaagaagcgggaattccgtatcaattcgattccattgccggagggggcacggattcaggttctattcatttaaccgcaaacggagtgccggcgctgtccattacgatcgcgacgcgctacattcacactcatgccgctattttgcatcgggatgattatgagaatacggtaaaattgatcacagaagtaattaaaaaattagaccgggaaacggttgaccgtattacttatcaataaagatacggaagaatctgcttttttaagcagattcttttttttttgtctgtacaaatatgagccttgcgtctacaataagaaaagacatagaaaaatctgacaacatgtttttgaaagcgctttaaaaaaagggaggtttacaaatgaaaaacagattcagacgcatgatccgcttttcatgcgcagtcgttacagccggtctgcttctgatgtcttcatctccggcatctgccgcgttttggggggcatcaaatgaattgcttcacgatccgacaatggcgaaggaaggaaacacgtggtacgctttcggaaccggtttggaaggggagagggggcttcgcgtcttaaaggcgggcagcggcggcgtatggaccgttcagaaatcaatctttacttccccgctgtcatggtggggcaattatgtgccgaattacgggctgaatcaatgggcccccgatgttcaatattttaacggaaagtattggctgtattatgccgtttcttcattcggcaaaaatacctccgcgatcggtcttgcatcatctacaagcctcagttcgggaaactggaaggacgaagggcttgtcatccgttcgacaagcgccaataactacaatgcaattgatccggagctgacaattgataaagacggaaacccttggcttgccttcggttctttttggagcggcattaagctgacaaagcttgataaaaatacaatgaaaccgacgggatcactttattccatcgctgccagaccgaataacggcggagctttggaagcgccggccatcacctaccagaacggctactattacttaatggtgtcgtttgataaatgctgttcaggggtgaatagtacgtacaaaatcgcttatggaagatccaaaagcatcaccggcccatatctcgataaaagcgggaaaagcatgtctgaaggcggagggacgattcttgattccggcaatgaccgctggaaaggcccgggcggtcaagacattgtgaacgggaatattttagtgcgtcatgcgtatgatgccgaaaacagcggaattccgaagatgctcatcaatgatatcgattggagttcaggctggccttcctattaattgatcagccgggcatgtgtgtccggcttttttacttgcaataaaagattgacagtttgattcctccttaactataataaagttgttcgtacaaataaaagaataaaagttttattatttatattcgtacgtatatttatttaaaaatgcaagcgctttattttgatgggaaggggaaatgaatgtgcttcagaacaaagaatatgaattttggtttgtaacgggaagccagcacttatacggagaggaaacgctgcagcttgtcgataaacacgcaaagggaatatgtgacggtctcagcggggtgtcatcaagatacaagatcaggcataaaccggttgtcacgtcatctgaaacgatcagagaggttttgcgggaagcgcagtatcaagaaaactgtgccggggtcgtgacgtggatgcatacattttcccctgcgaaaatgtggattgaaggtctttccgcttttcaaaagccgatgcttcatctgcatacccagtatcatcgcgacatcccgtgggaaacgattgatatggactttatgaacagcaaccaatccgctcacggagaccgggagtacggatatatccagtcaagaatggggcagacgagaaaagtcatcgcaggctattgggatgatgaggaagtcaaacatgacatttcgcaatggatgaacacggctgccgcttggaatgaaagcaggaatattaaagtagcccggttcggcgacaatatgcggaatgtggcggttactgacggagacaaagtcggcgcccacattcaattcggctggcaggttgacgggtacggaatcggcgatcttaccgaggtgatgaacaatgtcaccgacgcagaaattgaggcgctttatgaggaatacgacaaattgtatgtcatcagcgacgaaacgaagcgggatgaagcaaaagttgcttccattaaagaacaggcgaaaattgaactcggattaacggcctttctcgaacggggcggatatacagcgttttcgacctcctttgaagttttgcacggaatgaagcagcttccgggtcttgccgttcagcgtctcatggaaaaagggtacggatttgccggcgaaggcgattggaaaacggctgcccttgtgcgaatgatgaaaataatggcggacggagaacaaacctccttcatggaagattatacgtaccattttgaaccgggtcgtgcgatgattctcggatcacatatgcttgaagtatgtccgacgatcgcccttgatcagccgaaaatcgaagtccatccgctctcaatcggagggaaggaagatccggcccggctggtttttaacggaatcggcggttcagccatcatcgccagcatcattgatatcggcgggcggttccgtctcattctgaatgaagcggaaggcagggaaattgatcatgatatgccgaatctccctgtggcgcgggtgctgtggaagccggagccatcgctgaaaacagctgcggaagcatggattctggcgggaggcgcccaccatacctgtatgtccttccggcttacggctgaacagatgcttgactgggctgagatggcaggcattgaaagcatctttatttcccgcaatactgaaatacatgagctgaaaaaagagctgaaatggaatgacgtattataccggctgggagggaattgatatggcgtatacgattggtgttgatttcggcacattgtccggccgggcggtgcttgtcaatgtccgcacgggcgaagaaatcgcgtctgcggtaaaagaatacactcatgccgtcatcgaccgcacgctgccgaagacgggtgaaaaactccctcgggactgggcgcttcagcatcctgccgattatatcgaagttctggaaacggcgattccgaacctgcttgagcaggcgggcgctgatccaaaagacgtgatcggcataggaattgatttcaccgcctgcacgattttaccgatagacggcgcggggcagccgctttgtatgctgccggaatttgaacgggagccccacagttatgtgaagctgtggaagcatcatgcggctcaaaaacatgcagaccgtttgaacacgattgccgaagacacaaaagaaacattccttaaaagatacggcggtaaaatttcttctgaatggatgatcccgaaaatcatgcaaatcgcggaagaagcgccgcatatatacaaggcggcagatcggattgtggaagcggcagactggatcgtctatcaattgtgcggttcattgaagcgaagcaactgcacggccggctacaaagcaatctggaatgaggagacggggtatccgccggatcattttttcgaaaagctcaacccgttaatgaaaacgattacacaggataaattaagcggcgcgatttattcagtcggggaaaaagcaggaggtttgaccgaaaaaatggcggagctgaccgggcttctgccggggacggccgttgccgtcgccaatgtcgacgctcatgtgtcagtgcccgcggtcggtattacagagccggggaaaatgctgatgatcatgggaacgtctacctgccatgtgctgctcggcgaggaagaacatatcgtccccggtatgtgcggggtcgtcaataacggcattttgcccggatatgcgggatatgaagcggggcagtcctgtgtcggcgaccactttgaatggttcgtcaaaacgtgcgttccgagagactatgagaaggaagctgaggataaacacatagacattcacgagctgctcagcaaaaaagcagcagaacttgttcccggggaaagcggccttctcgcgcttgactggtggaacggaaaccggtcaaccttggtggacgccgatttgacgggcatgatgctcggcatgacgctgcacacgaagcccgaagaaatctacagggcattgattgaagcgacggcgttcggaacgaggatgattatcgaaacgttccgggaaaacggcgttccggtcgaggagctttacgcagccggaggaatcgccgaaaaaaatccgtttgtcatgcagatttacgcagacgtcacaaatatggacattcaattatccggatctccgcaggcgcctgcactgggctccgcgattttcggagcgctcgccgcgggacgggaaaacggaggattctccaatattgctgaagcttgcgcgcatatggggaaattaaaagacggcttttatgccccgaaccgggaaagagctgagatttatgacagcttatatgcggaatataaagagctcgtacactacttcggcaaagaaaacaatgtcatgaaacgcctgaaagccattaaaaaccgtgattttgcgaaaggggggagccgccatgcttgaagcgttaaaagaagaagtgctcgccgccaatctgaagcttgaggaacataaccttgtcacgtttacatgggggaatgtcagcggcattgacagagagagcgggagaatcgtcattaaaccgagcggtgtcgattacagtgagctgaccgctgacaagctggtcgtcctgaatgaggacggagacattttggaaggctcgctgaaaccgtcttctgacacgccgacccatctttatctgtataaagcgtttccggctatcggcggaatcgttcatactcactcccgctgggcgacgagctgggcgcagtccggaagagacatacccgctctcggaacgactcacgcggattactttgaaagcgctataccctgcacgagggaaatgtatgaagaagaaattgtgaaagattacgagtatcatacaggcaaagttatagccgaaacctttcaaaacgaaccgtatgaacaaaatccgggtgtcctcgtccacagccacggcccgttctgctggggaacggacgcgctgaatgccctgcataacgccgttgtgctcgaaacggtagcggaaatggcctaccattcgcttatgctgaacaaacagctcagtccgatcgacagagtgctgcatgataagcatttttacagaaaacacggggcgaatgcttattatggccaaacttgacgcagccgggtttctgattgatttagacggaaccgtattcagggggcgggagctgattgacggcgcaaaagaagccgttcatacccttcagtcactgggcaaagccgttgtctttttaagcaaccgcggcaatctatcaaaagcaatgtgcagaaagaaactgctgggtgccggtatccgcacggatgaacggagcatcgtgctgtcctccagtgtgacggcatcatttttaaagaagcattatcctttgtcaaaggtctgggtgttaggagagaaagggctgactgatgaactcgctttagcgggtgtcgtcctggcgcaaaacccgcaggcggcagactggcttgtcatctccctgcatgaaaccgtcacctataaggatctgaatctcgcttttaaggcggcttcctccggcgcgcgcatcatcgccacgaacaaagaccgctcctttccgaatgaaggcggtcatgccatggatgtcgcgggaatgatcggggccattgaagcatccgccggagcaaaaacggagcttgtcatcggcaaaccgtcttggctgatggctgaggcggcatgtgaagcgctcggacttccccctgaggaatgcgccataatcggagacagcctcgaatctgatatcgcaatgggcaggctgtacggaatgaaaagcatattggttctgacggggtcggccaaacttggggagccccgtctatatgaacctgacatcgtccttgattctattaaagacctgacagaattagcgaaggagggaatccttttatgaaacgttctcctgaggacattcaatccgagtttgacaaggaaggggccagccgctcaccgattcaaatagaagatatcgtgatcggggcgaatgcaaaagaagagcttctcagatttctgcaaaaaaaatgctggaatcatccggtcatcgtctgtgaccggaacacgtacgaggcggcgggacgtctgcttgcggacgaattaagggcaggcggaatcaaagcgtcaaaagtcatcattccggagcatgaagccggggccgccgcggctgatgagaggacattggtctatacgctgatcaatctcgcggaagagacggatgttatcatagcggccggttcaggaacgattcacgacattacgcggtttgccgcttatcagcgcggattgccgtttatctcattccccaccgctccgtcagtcgacggttttacatcggcgggagcgccgctcatattaaacggaatcaaaacgacgattcaaacgaaagcgcccatcgccttatttgccgatacgaatgtattaaaagaagcgccccgttcaatgacagccgcgggcttcggagacatgctcgggaaaataacatcgctggctgattgggagatttcccgcaggcttgcgggtgagccgtactcagaagccggggcgaagcttgtgaaagacgcgctttggcagtgcattgatcaccgcgctgacattgccatgggaacggaggccggcattcagatactgatggaagcgctgatcgtttcgggtcttgtcatgcttgctcttgaccactcccgccccgcctcaggaggagagcatcacatctcgcattggattgagatggaaatgctgaaggcaaaacagcctccgattctccacggtgcgaaggtcggctgtgcgtgcgcggtgctgagtgatatttacaaagaactggcttgtcacgaaaagcttgctgaactgccgccgcactttcgcgaggcgattcagtccgcatatgaagggcttcccgacggcaaaacaattgccgggtggctctcatctgcgggaggtcccgcctgtttcgatgagatcggtgtaaaaaaggaccttgtcagcgatgcgcttaagcatgcgcacacactgcgagaccgttataccggtttaaccatcataaatgaaaatgcagcgctctttgcacatcatttgcatcaatagccgcacggcctaaagtggaaggggtaatgacatgaaaaaaacgaccgctgtatgtttggtgctgatgatgctcttcttgtttaccgccggctgttcacaagaacggactgccggccggccgggagaaacggagctgacgttttggacgtttaacggtctgcacgaacagttttatcaggaaatggtcaaagaatggaatcagaagtatccggatcgcaaaatcaagctgaataccgttgtttatccttatggacaaatgcatgataatttatcggtttcgctgatcgcgggtgaggggcttcccgatatagccgacgtggaattaagccggttctcgaactttctgaaggggaaggatatcccgcttgccgatctgacgccgctgattgaaaaagaccgcgataagtttgtggaagcgcgtctggccttatacagcaaaaacggaaaattgtacggccttgatacacatgtggggacgaccgtcatgttttacaacatggatatcatgaaaaaagcgggcgttgatcccgcctccattaagacatgggaagattaccggcgggcaggaaaaaaagtgcgtgaagccgctgggaaaccgatgggaacggttgaaacaaacgactccgccacattcctatccatgatttcgcagcaagggtcaggctactacagcaaaaacggaaaattgattctgaacagcaagacgaatacagatacactgaatgatgtaaaggacatggtaaatgataaaacccttctgccggctcccggcggcggccatcacagcgaagaatactacggttttatgaatcagggcggggcagcctcagtgctgatgcccatttggtacatgggacggtttatcgattatatgcctgatttaaaagggaaaatggcgatttaccctatgccggcctggaaagaaggcggtgacagatcagcgggtttaggcggaacagccaccgtcgtgccgaagcaggctgaacatctggagctcgcgaaagaatttctcggatttgcgaaaggttcaaaggaagggaacataaagctgtggacggtgctcggctttgacccgctccgctgggacgtgtgggattcaaaagaattgaaggagaaaaacaagtacacggatttcttccggaacggtacgtcaattttttcctcgctccttgaaataaaagatgagatcaatccgatttatctgcatgaagacttctctaaagcggctgatctcgttgtcagacaggtgctgttcgatgcgctgaagacgcaggaaaaaacacctgaggaagccttggacgaggcggcagagcaattagaaaaataggagaagccgccctatttaacagtgaaagcgggggagcttttatgagacctgtaaagacagagacagcgcaaaccgtttctgcagtccggaagaagccgcgccggcgcaatgtgctgtattcaaaaaaagcggcgccttatctttttacggcgccatttatcatttcgtttctcgttttctttttgtatccgatcatcagcgtgtttatcatgagctttcagcggatactgccgggagaaattacatttgtcgggttttccaattataccgctcttcttaatccaaccttttatacggcattatttaacacattggaatatactttctggacgctgatcgtgctgattccggtgccgcttcttttagcggtgattctgaattcgaagctcgtcaggttcagaaatgtgtttaaatcggctctgtttgtaccggctttaacatcgacgatcgtagcggggattattttccggctgatgttcggagaaatgaatacgtcgcttgcaaacgagctgatgatgaagcttggcgcatcaccccaaaactggctcaacaacaaaggtaccggcatgtttttaatggtgctgcttgcgtcatggaggtggatggggattaacattctttactttctggcgggtttgcaaaatgtgccgaaagaattgtatgaggcggctgaaattgacggggcgagtacgtggaaaaagttccggcatatcacccttccatttttaaagccggtgtccgtttatgtgttaacgatcagtatgatcggcggtttcagaatgtttgaggaaagctatgtgctttggcagaataattccccgggcaatatcggcctcacgcttgtcggttatttatatcagcaggggcttgcatacaacgaaatggggtacggggcagcaatcggaattgtccttttgcttgtcatcttactagtcagccttgtttcactgaaactgtccggttcgtttaaaggggagggataagcgttgcgtaacaatcacatgttttccgtgtacagagtcgcgtttaccttgttttttatcatgctgagcctgttgtatatctttccgatgatctgtctattgctcggttcattaaagccgtcatctgagctgatgcgcatcgggctgaatctgcgtcttgatccggatgtgatgagccttgataactacacctatttgttcaacggggggagcatttattttaaatggttttttaacagcctgctgctcggcgtcctcaccacggttctcacgctgtttttttcctctttgatcggctacggactcggtgtctacgagtttaaaggcagaaatattattttcgttcttgtgctgatcattatgatggtgcctcttgaagtgatgatgctcccgttgttcaaattgacggtgggtcttcatttaatcgattcttatacgggggtgattctgccgtttattgtgtcgcctgtcgccgtgttctttttccggcaatatgcgctcggacttccgaaggatcttcttgattcagcgagaatggacggctgcaccgaattcggcattttcttcagaattatggcgccgctcatgaaaccggcattcggagcaatgatcattcttcaatctttaaacagctggaataactttttatggccgctgatcgtgcttcggtcgaaagaaatgtttacgcttccaatcggactttcagggctgctgagtccgtacggcaacaactatgacatgctgatttccgggtccgtttttgcgatactgccggtgatcatcatattcttgttttttcaaaaatacttcatttccggcctcacagtaggcggagtgaagggatagagagagggaggaaatgtaatgaaaaaagcggggattacagcagataaagaatatatcatcggtgaagtggacaaacggatgtacggatcttttatagaacatatgggccgggcggtgtatgaaggcatttatgagcccggacacccgaaagccgacaaggacggtttcagaacagacgtgcaggagttaatcaaggaattgcaagtgccgttcatccgctatccgggagggaattttctctcaggctacaattgggaggacggcgtcgggccggtgaagaaccgcccgcggaggcttgatttggcatggcagacgacagaaacgaacgaagtggggacgaatgaatttttaacgtgggcgaaaaaagtgaacgccgaagtgaatatggcggtcaatctcgggacgagaggaatcgatgccgcccggaacctcgtcgaatactgcaaccatcctgaagggtcatactggagcgacttacgaaaatcgcacggatatgaaaaaccttacggcatcaaaacatggtgcttaggaaatgagatggacggcccttggcagatcggtcataaaacggcgcatgaatacggacggcttgccgctgaaacagcaaaggtgatgaaatggacggacccgacgatcgaattggtggcttgcggaagctcaaacagcggcatgccgtccttcatcgagtgggaggccgaggtgcttgagcatacgtacgagcatgtggattacatttcactgcatacgtattacggcaaccatgaaaatgatcttgagaactatttggcgaagtctatggatttagaccattttattaaatccgtcacagccgtatgtgattatatgaaagcgaaaaaacgcagcaaaaaaacgattcacctttctttagatgaatggaatgtgtggtatcactcaaatgaagcggataaaaaagtggagccatggattacggcccggccgattctcgaagacatctacaattttgaagatgcgctgttgatcggttcactgctgattacgatgctgcagcatgcggacagactgaagatcgcctgtctcgcccagcttgtcaacgtgattgcgcctatcatgactgaaaagggcggagaagcatggaggcagccgatcttttacccttacatgcacgcctcagtctacgggagagggacttcgatgaagctgctgatcacctccccgaaatacgactcggcggactttacggatgtgccgtatgttgatgccgcggccgtttaccatgaagaggatgaagcactgaccatttttgccgtcaacaaaagcaaggaaccgatggaaacggagatcaaactgagggggtttgaagattaccgcatcattgagcatatcgtgctggagcatcaggatatgaaagcaaccaatcaaaaaaacagaaaagaagtcattcctcactccaacggaacgtcttcggcaaacgctgaagggataacggcacattttactccgctgtcctggaatgtcatccgtttatcaggaaaataatgttccgaaaagccgggctgccgctgccggcttttttttacgcaaaaatcatctcctgttatctgataattatgataatatttagaaaaagagaaaaggggctgggattaaatgaatgcgattacaatcgtcatagcgtctatatgtattttggcgatcgcctatcggctttacggtacctttatgatggtcaaagtattaaaaatcaatgatcagacaccgactccggcccatgtgcttgaggatgggaaagattatgtgcccacgaataagtgggtgtcattcggccaccacttcgcggcaatcgccgctgccggcccgcttgtcggaccgattctggcagctcagtttggctatctgcccgggcttttatggctgttaatcggagcggtgatcgggggagccgtgcacgatattgtcgtattgtttgcatcaatgcggaaaaacgggaaaacgctttctgaagtcgccaaagaagagctcggcccggtggcgggcttttgcaccggtctttccatgctgtttatcattacgatcacgatggcgggtctgtccatggttgtgctgcacgcgcttgagaaaaacccgtggggaacgtttgcggtggggattacgattccgatcgcgatgggggtcggcctctactataaaaaaacgggcaatctcaaactcgcatcaactgtcgggtttcttttgttaatggccggtgttgtaatcgggccgcggctgcagacaacggctctcggggacatgctgacacttgatgcgaaaacgcttgcagtggcgcttcccgtctatgcgtttttcgccgcggcgcttccggtttggcttttgctggctccgcgtgactatttaagcagttttatgaaaatcggggtttttgccgctttgatcgcaggcgtctttttcgtcaatcccgccattaaattcccggccgtaacggagtttattcacggcggagggccggtgatcgcgggtcctgtctggccgtttatttcaataacgattgcctgcggcgccatttcgggctttcatgcatttgtcggttctggcacaacgccgaaaatgctggataaatggagtgatataaaaccggttgctttcggagcgatgcttgtggaatgtctcgtcggaattatggcgctcattgcagctgccgctcttgagcccgccgactattttgccattaacagcacgcctgaaatattccgcgccctcgggatgaatgtcgtccatctgcctgaattgagtaaagaaatcgggctcagtctggaaggaagaacgggcggagccgttacgcttgccgtcggaatgacgtatatctttacggagattccgtttttcagtcatttggcttcatacttttttcaattcgtcattatgtttgaagcggtgtttattttaacggcgattgatgcgggaacccgtgtcgcccggtacttgattcaagagtttttcggagaggtctataagccgctgaaaaaaacagactggctgccgggctcgattttctcaagcgcgctcgcctgcctgctgtggggctatcttctgtattcgggcgacatcagttccatttgggcgctgttcggcgtatccaatcagcttatggcatctgtcggcttaatcatcggtgcgaccgtcgtattaaaaatagcggataagcggcgctatatgctgacatgcctgattcctctcgcttatttgtacgtgaccgtcaactatgcgggttattggatggtgcggtatgtgtatttgaaccccgaagcggcgggatacaacgtgctgaatggcgttttatccattatcatgctgattctcgggcttgtgattatcattgcggctgtgaaaaaatgggcgaatgtatggcgtgatccgagtgccagactggaagcttcaatacccggataaatccgcggccgatccgaacattgtagcatcataaaggcagagagccgatcggtctctctgctttcggcttatgacaaatccgccgcttccaaaaggtaatccgccaaatgaaccgcgcggacacggcctgttaatccttcgcgtaaaatgccgagctgcatttgcagaaggcatccgggattggctgtcacgatgacggccgcctccgtttttccggcggctttcatcttgctgtctaatattttcatagacatttctgactctgttatattataaattcccgccgacccgcagcagctgtcggccttttccatttctctgtactcagcccctttaatgtttttcaaaagcgtgcgcggttcttctgacgtatgcatcacattgcggagatggcaggagtcctgatatgtgacgatatgaggagactgcgcccgcaggtttttttgatggaacttcagatcaaccagtacggatgaaaagtctttgagcttccggacgaattgttcggcacgttccgcccatccaggttcatctttcagtaaatgcggatattcctgaagaaaggcgccgcatccgccggcgtttgtaatgatataatcagcgtcaagcgcctcaaaagcggcgatattccgcttggccagttcttttcccatctctttttctccgctgtgcccgtgaagcgcgccgcagcacgcctggccgtccggaaccgcgatttcacacccggccgcctgtaaaagcgccgttgtcgcatgatttgttgctaaaaacatcgtatccattaagcagcccgagaaaaaagcggcccgtttttggacgggacccgcggcaggaagaaaacgcggcctttccttcatgtctttccgtttcggggcgggcgggagcacttgttccattgtgcgcagatgttcaggcaaaacgcgcagcataccggtttttctgatggcggtctgcagtcccgatctttggtatattccgagaagattcacggctgcctgcatgcggttttgatgagggaaaagcccggtgaaggcggctttccgcaagaggcgcacgccgggcttatgttttttattttgatgaatgatatccctcgcttcttcaagcagctgtccgtaattgacccctgccggacaaacgggctcgcatgcccggcatccgagacacagcgaaagtgagcgctcgacatcttcatccggttcgatcagtccgtctgtgacggctttcatcagggcgatccggccgcgcggcgaatgggattcttgaaatcctgattcgatataggtcggacaggaaggaaggcagaagccgcagcgcatacagttcagcaattcaccttcatccatgcggtttttgaattctgtttgaatgtgttgctgctctttagccgttgtcatttcatcatcaccacgcgtttccttgatgaattggcgaatatttttcccggattcagcagattttggggatcaagcgcttgtttgatcgctttcatggcggtaatgccttctgttttcagcttcatttctaaatacggcgcttttacgatgccgaccccgtgttcacccgttatcgtcccgcccagctcaatcgctttttcaaaaatggcggcaaaagctttttcgacacgttccatctcctctgtatttcggatatcggtggtgcacgtcggatggaggttgccgtctccggcatggccgaatgtgcagatggacaggccgtatgtttctgcaatctcgttaatggctttgaccatgccggcaatttgtgatctcggcacggtcgcgtcttccagaatcgtcgtcggtttcagccgggcaagggctgataatgcggaccgtctggcctctgtaagcgcgaatgcctcttcctcggtttcggccgtttggacggatacggctgctccgtttttacagatggcttcgattttttccatatctcgtctgaccgtttcgatgtcaccgtcctgttcgatcagcagcaccgcttttgcatcggtcggaagcccgatcttggcgtaatcttcaatgacctgcagtgtcggctgatccagaaattcgagtgtcgccggaatgattttttcagcgatgatggcagaaacagattccgcagccgcttcaatatgttcatagagtgcaagcagcgtttttttcgtttccggcttcggaaccagctttaaagtcgcttccgtcacaacgccgagcgtaccttctgatccgacgaaaagccgggtcagatcataaccggcgacatcctttgtcagcttccctcctgtgcggatgatatcgcctgaagccaagacggcttcaaggccgaggacataatcccgggtgacgccgtacttcaaaccgcgcagcccgccggaattttcattaatattcccgccgatcgtcgatattttcatgctgctcggatcaggcggataaaataaccctttcctttcaaccgcatgaatcatatcttgcgtgatcacgcccggctggacggttgccgtcaaattttcttcatcgatttcaagaatgcggttcatatgtttgaataaaagcacaagcccgccttcagacggacatgtgccgccgcataagtttgtgcctgaacccctcggcacgatcggaatgtcatgcctgctgcaaatcgttaatatacgggacacgtcatccgcgctgcggggagcgattaccgcatccggcatggcttgcagctgaggagccgcatcgtaagaatacacaagacggccagccgccgaatcatcataattctccttcccgaccgtccggatgaacgcttcttttgcctctcgtgaaatcatgttctccaacctccctgataagaaaagcgttttcatttaattgtaaagaaaaacgattcttcacactatggagaaacatatgaaaaatgatgatatgattacgtgctttttgtatgttgatctaaaaagcggagcgccaaataaaaagccgttatgtcttcggggcggtcaagcttcatatttgtcagtgattccagtttggaaagacggtagcgcaatgtattgatatgaatatgcatgtcgtctgcggtgcgctttaacgataattgccggtcgaaaaaggcgcgcagcgtatccagaagttcttcccggccgagtacatgctcgagaacccgccgtgaaaattccgacctcgtgccgggcgcgatatcggcaatacacatatccagttttaaatcttcttcaaagacggcctgcttgtcaccgattccggctgaaagtgctttatccgcctgttcgtatgattccgcgaggcgctctcccggaacgatccgtccgatgccggcggtgacaggctgcccaaaaacggcgccgatctttttgatgagctgtgttttggaagccgaatttgcttcatggttaatgagaatgcgttcatttccccagcggacaaacaggtcttcagggcattcgttctgccagagccgcccgagctcctccgctttatattgctcataacgtccttgaatgagtatgatccggcggtatgcgtgaaggtctgcgccgatgagctttgctttttctaaaaagcccggagaccattctttcagctgcagccaatcaaccataaaggattcaagcattctcgcacgccactgcgcttcttccatatggcgcgtttctttaataaacagctccgtcattttcctgagcaattctccgaaaggcaggatatcgtcagggtctcctgtcagaccgaacactccgattacctcatggcctgaaaaaacggggaggttcagtcctgcttttacgccctggaggcgtttttcatcttctttcgtaatgatgacattccgtttttcgcgggcgcagatcagtgcgccttcatgaaaccatccggcgcgcgcctcattggtgcccgcgatgatcatcccttttgtatcggcaataatcacttcgcggctgtacatatgtttgacttcggcaatcaatttctttgccagttccggctgtaactgcatggcgatccccctcgccattattatacaaaaaaaaccgggtgtgccatcacccggttcatgcttattgcgcaggttttaatccgccttcaagtgttttgagcatttcatttttttctgagtctgacgcatgctgccaaagaacttcgaataagacgccgaggcccggaagcattttttcttcaccgctttggatggcgtcaacgatagtatgctccagctgatcctggttattgccggttacattggcaataacggcgttgcgtaaattaagatccattacaaccgctcctttttcctgaatgtgatacgcatattcttaccgcgcacgcggtttattatgtgctgttcttgagatataataacaacatgcatgaaaaaaggagagcacagacataaagtgaaacgaatcgactctgcaaaaaaccaaaaagtgaaggactggaaaaaacttcacacaaaaaaagagagacttaaaacgaatacatttctgatagaaggagagcatctggcagaagaagcgctcaaatcaaagggaacggtaaaagaaattctcgtaaacgatgagagcgccattccggccgatctggatatgagcattccgtgctacgtgctgagcgaagacgcgttttcagccgtgacggaaacggaaacgccgcagcggatcgccgcggtctgccatatgccggataagcggcctgatcagctgaagcggctgcttctgattgatgccgtacaggacccggggaatttaggaacaatgatcagaacggcagatgcggcgggaatcgacgccgttgtccttggtgagggaacggcagacccgtacaacggaaaaacgctgcgttcagcgcaaggatctcattttcatattcccattttaaaacgtccgcttgatgagtttaccgccgagctgaaatcacaaggcgtcgcgatctacggcacggcgcttgaaaacggtgcggcttatcaaagcgtgaagcctgaagaatcgttcgcgttaatcgtcgggaacgagggggcgggagtggacgccggccttctgcaaaaaaccgatctcaatctgtacgttccgctgtacggacaggcggaatcgctgaatgtggcggtagcggccgccatcctcgtttatcatctcagaggataggttgcgaaaaaccttggatttcactataatagatagcaataatgtaaaaaccgtgacagaggacgtcaatttttgcacacgctgccttccagggagaaaatgccgctgactgagagcatttttatcgcagcacagaaattgattttcacctctcgagttgtcaccgggaccgcgccaaacgcgcgtaaaggtgaaccggaacgatcgtttccgttatgtcaatgaagctgtcggcagatgaagtctgccttaaaaagggtggtaccgcggccacaactcgtcccttctctcaaggggcgggtttttttgttttctgaaaaaggcatagaacggtttggtttacataaaaggaggatgcatgatggaagagaagcttaaacagctcgaactggaagctgcagaaaaagtagaagcggcgggttcattaaaagaagttaacgacattcgggtgcaatatctcggaaaaaaagggccgattacagaagttctccgcggcatgggcaaactgtccgccgaagagcgcccgaaaatgggagcgctcgccaatgaagtgagagagcgcattgcagcagccattacggcgaaaaatgaacagcttgaacaagaagagatgaataaaaaactcagcagccagacgattgacgtcacgttgccgggcagtcaggtaaacatcgggggacgccatccgctgacggtcgttattgaagaaattgaagatttatttatcggcatgggatataccgtcgaagaaggccctgaagtggaaacggattattacaactttgaggcgctgaacctgccgaaggaacatccggcccgcgacatgcaggacagcttttacattacagaagaaatgctgatgagaacgcagacgtcaccggtgcagacgcgaacgatggaaaagcataaaggaaaaggccccgtcaaaatcatttgtcccggtaaagtgtatcgccgcgacaacgatgacgcgacacattcccatcagttcatgcagatcgagggtctcgtcgtggaccgcaaaatcagcatgagcgacctgaaaggcacgcttgaattggtcgccaaaaaaatgttcggccaagaccgtgaaatcaggctccgtccgagctttttcccgttcacagagccttctgtcgaggtggatgtgacctgctttaagtgcggcggacaaggctgctccgtctgcaaaaaaacaggctggatcgaaattctcggcgccggcatggttcacccgaacgtgctgaagatggccggattcaatcctgaggaataccagggttttgctttcggaatgggtgtggaacgtatcgcgatgctgaaatacggcattgaagatatccgccatttctataccaatgatgtcagattcatttcgcagtttaaacaggcgtaagaggaggatacacatgtttgtttcatataaatggttagaagattacgttgacttgcagggaatcgacccggccgtgcttgcagaaaaaattacgagagccggtattgaagttgagggtatcgagtataaaggggagggcgtaaaaggcgttgtcatcggacacgtgcttgagcgtgaacagcatccgaatgccgacaaactcaacaaatgccttgttgatatcggtgcggaggaacccgtgcagattatctgcggcgccccgaatgttgataaaggacagaaggttgccgttgcaacggtcggagccgtgcttcccggcaatttcaaaattaaaaaagccaagctgcgcggcgaagcgtctcacggcatgatctgttcccttcaggagctcggcattgaaagcaagctcgtggcgaaagaatatgcggaaggcattttcgtttttccgaatgatgctgaaacgggagctgacgcaatggcggcccttcagcttgatgatgcgattttagaattcggcttaacgccgaaccgcgccgacgcgatgaacatgcttggcgtggcttatgaagtggcggctatcctcggcgcagaggtaaagcttccggaggcttcatatgaaaaagcggcagaaaaagcggcggatgctgtttccgtcaagattgaagatacgcaggccaatccgcattatgccgcaaaaatcattaaaaacgtcaaaatcggcccgtcaccgctttggatgcagacgaagctgatgaatgcaggcatccgcccgcataataacgtcgtggacattacaaacttcgtcctccttgagtacggacagccgcttcacgctttcgattacgaccggttcggttcaaaagaggtcgtcgtcagaaaagcggcggaaaacgaaaccatcgtgacgctggatgaacaagagcgcaagctgtcaagcagccatttggtcatcacaaacggaaaaaaagcgcaagccgttgcgggagtcatgggcggagccgagtctgaagtccgtgaagacaccactgcgattttactggaagccgcttatttcgacggacagaccgtccgcaaagcgtcgagagacctcggactgagaagcgaagcgagcgccagatatgaaaaaggcattgatccggcccgcgttttgctggcggctgaacgggcctgcagtctcattcaggcatatgccggcggagaagtgctctcaggcacggttgaagaaaaccatctgaaaatcgaagcaaacaacattcacgtgtctgttgaaaaagtgaacgccgtgcttggcatggcaatcgctaaagaagaaatcatcagcatttacaagcgcctcgggtttgcagtcagtgaagctgaagacgttctcgtcgtaacagtgccgtcccgccgcggagatattagaatagaagaagacctgattgaagaagcggcgagattgtacgggtatgacaatattccgtccacgcttccggaaacggccggcacgacaggcggcttgacaccgtatcaggcaaaacgccggaaagtgagacgtttccttgaaggagcgggtctttcacaagcgaccacttattcattaacgaatgataaaaaagcggccgcttttgcgatcgaaaaatcattcaacacgatgcttgctctgccgatgagcgaagaaagaagcattctcagacacagtctcgtgccgaatcttcttgaagccgtttcatacaatctggccagacagactgattccgttgctttatatgaaacgggttctgtatttctgacgaaagaagaaaacacaaaaccggttgaaaaagaacgggttgccggagctgtaaccggattgtggcgcaaaaatttatggcagggtgagaaaaagccggttgatttcttcgtcgccaaaggaatcgttgaaggcctgctgcatcaattgaatgtgtcagatcgggttgaatttgtccagtctgcacgcaaaaacatgcatcccggccggacggcaaacattctattgaacggttcgcttgccggatttatcggccaggtgcatccggcaatggaaaaagagctggatatcaaagaaacgtatgtgttcgagcttgatctgcacgcgcttctgaccgaggaaacagaacctgtcgtgtatacgccgattccgaagtacccgtccgtcacgcgcgacattgcgcttgtggcagataaaaccgttacaagcggacagctcgaagccgtgatcaaagaagccggcggcgcgctgctgaaagaagtcaccgtatttgatgtgtacgaaggtgagcatatggaagagggcaaaaaatccgtcgccttctcgctccaatatgttaaccctgaacaaacattgacagaagaagaagtgacaaaagtacatgaaaacgtgctgaaagcgctggaagaaacgtatcaggcggtattaagaggataaagaaaaagcttgcagatcattctgcaagctttttttattatgaccgtttccgttctacaaggcgtttcgctttttgcgtattggcaaaatgaagtttggtgaacgttctgagcgcaccttctcccttattgatgatcagcttggcggcagcttcatcgacgtgcggccccgcgccttttggaatcgtcatcccagcctcacgggaaagcttatccatttcaattaagaaagaatatcgcgcaatgatagaggctgcggcgacggaaagatgtatgctttccgctttcgtgctgaaaaacgttttttcttttacgatatcccgtccggaaagatgcttaaaataaatgccgggctctgcaaattggtcaatcagaatcgcttccggtttaacgccgttcatttttctcagcagattggaaatcgcctgattatgaaggagcgccttcatttttccttggctcatgcctttttcctgcatctgattgtatttttcgtttttcaacacaagcaggctgtaaggaatggttttaattaacagtttggcgatttcaataatctgcggatcttttaaatccttcgaatccttcacaccgagttctttcattaaagaaagctttgttttgtcggcgtaagcgcaggcaaccgttatcggcccgaagtaatcgcctgttccgacttcatcagagccgatcactgacatggaggcaatgcccgccgggggagcgtaaagcggatcggccgcttttttgacggttttctttgccttcggcgcctcagccgttccccagcgggccgcttctgtgccggcgttttttccctgaaagagaaccttgcccgagcggtaggctgtaatggtacagcccgggggcttggcctggaagacggcgccctgcggaacggcgggagtaagggagccggcataggattgtttcatttgttccatagcggaagcggatacttttataacagaatgggacacgatataatctccttttttggcacttttcactgtatataccagtgtatcataacagcccgaggcttgtctttccattcaaacgataatcgtggtatgataggaactaggattctcgcggaatggaggagaaacgttgtctgacggcaaaaaaaccaaaacgacagtaaacatttacggccagcacttcaccattatcggggaagaaagcaaagcgcacatgcgccatgtggccggaatggttgatgataaaatgagagaaatcaacgagaaaaatccatatcttgatataaataagctcgctgtattgactgcggtcaatgtcgtgcatgattatatgaaactgcaagaaaaatatgaaatactggagcggcagcttaaagaaaaggaatgaacaccatatgatagatatcatcatcttagttctgctcttaatgggcacattgcttggattaaaaagaggatttatcctccaatttatatacttgacgagtttcatcctctcgattgcgtttgcggcgcttttttacaaaaacctggccccgcatctgagctttatacccgcccctgatttttccggcgggcaggcggctctgtcttttattaaaggaaacgtggagacggcttattacaacgcgatcgcgtttgtcattttgtttatcatcgcaaagatcctgctccggattatcggagcggcgcttaatatcatcgccggcattccggtcattaaacagatcaacaaactgctgggcggggtgcttggatttctggaagtctatttatttgcgtttatcctgttatacgtcgcatccgtactgccggtaagcgtgcttcaggatatgctcgcacaatcgacgcttgcaaatatcatcacacatcatacgccgtatctgtcggggctcctgcaagaactgtgggcccagtacggggcataaaaaacttctcttgaccggagaagtttttttcaagctctgcgtcagttgtgccggaagagaaaaatttgtatgatgaaaagcaggaaacgactgggggttaacagtatgcataaaaaagatatcatcaggctgcttgaaacgattgcggtctatatggaactgaaaggggacaacccgtttaaaatatcagccttccgaaaagcggcggcggcgcttgagcaggatgaccgcagcctgtcggaaatcgacgacatgatgtctttatccggaatcggaaaaggcacctacggcgtcattcgtgaatatatgcaggaaggtgtgtccggcacgcttctccaattgcagaaagaagtcccggaaggcttggttcctcttttgaagcttccgggcctcggcggcaaaaaaatcgccaagctgtaccaggagcttggcgttcatgacgcggaatcgctgaaagaagcatgcgagcagcaaaaagtacaggggctcgccggtttcggcaaaaaaacggaggagaaaatccttcaggctctcggagaagccggaaaacagccggaacggtttccgatcggctatgcgctcagcattgcttcagtcattgaagaacatttggcccggctgacggatattcagaaatattcccgggccggcagtctcagaagagcgcgggaaaccgtaaaagatctggattacattatcgctacagatcgtccggaggctgtcagagaacagcttctttccctcccgaacgtaaaagacgtgatagcgggcggggatacaaaagtatcggttatcctgacctttgaatacgagacgagtgtggatttccggcttgtgacagaggaacagtttgccaccacactgcatcattttaccggttctaaagatcacaacattaaaatgcgtcagctggcgaaagagcgcggtgaacggatcagtgaatacggagtagaaaccatagaaacgggagacgtcaaaacattcccgagcgaagaagcgttttacgcccacttcggtctgccgtttattcctcctgagctcagagaaagcgggcaggaggtcgacacgtaccgggaagaaacggaccttgtggagcataaagcgataaaaggcgatctccacatgcactcagcctggagtgacggcgctttttccatcagagaaatggcagaagcgtgtatggcaaaaggctaccagtacatggcgatcaccgaccattcccaatatttaaaggtagccaacgggttaacggccgaacggctcagaaaacaggcggaagaaattgacgcgttaaacgctgaatttgaaaattttcatatttttaaaggcgtagaaatggacattctccccgacggttcgcttgattatgatgacagcgttctgtctgaaatggatcttgtcatcgcatctattcattcaagcttcagccagccggagcatgtcattatgaaacggcttgaacaggcgctgacgaataagcacgtggacattatcgcccacccgacgggacgcctgatcggcagacgggccggctatgaagtcgacatcgacatgctgattgagctcgcagccaaaacaaatacggcgcttgaactgaatgcaaaccccgcgcgcctcgatttacggactgagcatctgatcaaagcaaatgaaaaaggtgtgactttggtcattaataccgatgcccataatatcgagatgctcgatgatatgaaaacgggcgtgaccgctgcgcgcaaaggctggacagagacaaaacatgtgttaaacgcccggccgttacatgaggtcaaagcatttctgacgcgcaatgattaagtaaggaggaccataaaaccgtgcagcaaaaagtgttatcatcacttgaatttcataaagtaaaagaacagattaccgcacatgccgcctcatcgctcggcagggagaagcttctgcagctgaaacctttgacggatctcgccgacatccaaaaacagctggatgaagtcgaagaagcatccgcggtcatgcgcttgcgaggccatgctccgttcggcggcctgaccgacataagatccgctttacggcgggcggaaatcggcagtgtgctgacgccggcggaattcaccgaattgtccgggctgctgtatgccgttaaacaaatgaagcattttatcagccaaatgacagaagacggcgtcggcataccgctgatacaggcccatgcagaagagctgattacattaggcgatttggaaagggagattaactcctgcattgatgaccatggtgaagtgcttgatcatgcgtctcccgctttaaggggaatccgcacgcagctcaggacgcttgaatcaagagtcagagaccggcttgaatcgatgctgcgttcatcttccgcttctaaaatgctgtctgacaccatcgttacgattcggaatgaccgctttgtcatcccggtcaaacaggaatacagatcaagctacggcggaattgtccacgatacatcttcatccggtgctacactgtttattgaaccgcaggcgatcgtagatatgaacaactcgcttcagcaggcgaaagtaaaagaaaaacaggaaatcgaacggattctccggatgctgacggagcatacggctgaacacacacaagaaatcgctcaaaatgtggaagtgctgcagacactggatttcattttcgccaaggcgagatacgcaaaagcaatgaaggcgacaaaaccattcatgaacggagacggctttatccgtctgaaaaaagcgcgccatccgctgctgccccaagatcaagtcgtggccaacgatattgaactgggcggagattattcaacgatcgtcatcacgggaccgaatacgggcggtaaaaccgttacgttaaaaacactcgggctgctgacgataatggcgcaggcaggattgcacataccggctgacgagggctcggaagcagccgtatttgacaatgtgtttgccgatatcggcgatgaacagtcgatcgaacaaagtctgagtacgttctcatctcacatggtcaatatcgtcaatattttaaaagacgtgtctgaaaacagtcttgtgctgtttgacgaactcggtgccggaacagatccgcaggaaggggcggcgcttgccatgagcatccttgacgaagttcaccggacaaacgccagagtgcttgcgacaacccattatccggaactgaaagcatacggatataacagacaaggcgtcatgaatgccagcgttgaatttgacattgaaacgctttcgcctacctataaacttctgatcggagtgccgggccgaagcaacgcatttgaaatctcaagacgccttgggcttccggagcatatcatcggccaggcgaagtcagaaatgaccgccgaacataacgaagtcgatctgatgatcgcatcgcttgaaaaaagcaaaaaaagagcggatgaagaactttctgaaaccgaatcactcagaaaagaagcagaaaaactgcacaaagagcttcagcagcaaatcattgagctgaatgcccaaaaagataaaatgatggaagaagccgagcggaaagctgcggaaaaactggaagccgccgcaaatgaagccgaacagattatccgcgagctcaggtccatcaagcaagaacacagatcctttaaggaacacgagctgattgacgccaaaaaacgtctcggagacgcgatgccggcttttgaaaaatcaaagcagccggaaagaaaaacagagaaaaaacgcgagctgaagccgggcgacgaagtaaaggtgctcacattcggacaaaaaggggcgctgcttgaaaaaaccggcgagaaagaatggaacgtccaaatcggcatccttaaaatgaaggtgaaggaaaaagatcttgagtttctcaaatcggctcctgaaccgaaaaaagaaaaagcaatcaccgccgtaaaagggaaggattatcacgtatcccttgaacttgacctcaggggagagcgttacgaaaacgccctcagccgcgtcgaaaaatatttagatgacgcggtgctcgccggctatccgagagtgtccatcattcacggaaaaggcacgggcgccctccgaaaaggggtgcaggatcttctgaaaaaccaccgcagcgtgaaaagctcgcggttcggggaagcgggagaaggaggatcaggcgtaacgattgtcgaactaaaataaaaagggagaaaacgtcatgaatgctttttgggaaaatgagcttgttgaaatcgcggcttattacagtgttgccgtcttgtgtctcgtcatttttctgaccgtgtttgaattggtgacatcctataaaaactgggtggaaatccaaaaaggcaatcttgcggtggcaatggcgaccggagggaaaattctcggtatcgcaaatgtctttcagcacagcatcgcccagcataattcgcttttgcaaatgatcggctggggcgtatacggatttattatgcttttaatcagctattttatctttgaatttctgacgccccggtttaaaattgataaagaaattgaaaaagataacagagctgtcggctttatttcatttgtcatctcagtcggcctgtcatttgtggtggccgccgggatttaaggggacggggaaaaatggagaagcttgcgaaagtgctgctgtcggcagcggggatttttctgttcatcggacttatttatctggtcatgacatcttaatactgaaaaaaggctgccgaactcaaatcggcggccttttttattgagaataccagtttatgcaggccgtatcagagcaaatgacggcttcccaattcatggcgcggacgacagactgaatgtcttgttcttccatgagaaagagtgtcgtaaaagaatcatatatgctcataaaagcggcgcgccgttttttcatcggcaatgatcatgtcagcccgcagcagtccgcatacatccgaagccgccgtttgattgagtgaaaataggcctttctcttcgacaggctcataataagtgcagcgctttatgccttttgaacggaacacatccaaaagtcccggaatcaaaaatggcgaagtgacatcatcgctcggcaagtacagatcgggatgatggagccgatttaaccgctcggcggattcaggatgtgcatattcctcccgcaatgccgtgacagcagtcataagcgcaagcgccgtttctttttcagaacgcaggccgcaaatgctcatgacggtttgccaggaaacgggtctgcccatcgcgatgatctcctcatcactcggatacatatgttcataaggccgtttgcgcttttgctcttcccgaccatctggcatccggacaaagggatggagcaaaaaggcggccgacgtaatcggcttcggcagctggcgcaggataggaactcccccttcaaaatgcagcgtttccagaaaactcaacacctcctgaaactcgaaatttcccatgaaacgctttcccattccaatcacccttctgctataataatagcgtataggaaaacagaagggagaggtattatgcagtctgaaaagccatggctttctcaatatcccgaagagattccgcatgagcttgaatttaccgatcaaaccctgccatccaatctgacaaactccgcagctcaattcccgaaccataccgccatttattttctaggaaaaaaactcacattccaagacgttctcacagattcattaaagcttgccgcttttttacgcaaaacaggcctgaaaaaaggtgacagagccgccattatgctgcccaattgtccgcagtcggtcatcgctttttacggcgtattgtttgccggcggcattgtcgttcagaccaatcctctctacacggaacacgagcttgagtatcagctgaaagacagtgcgccgcgcgtgatcatcaccctcgatatgctgtttccgaaagtgataaaaatgaaaacgttatcactcgtcgaacgcattattacaacaagtataaaagactttttgccgtttccgaaaaatatgctttatacgctcacgcaaaagcaacaggtgcatattgattatgacggctgcgaacaaattcacaaattagcggatattttaaaaaacgaaaaagcagaggaagcagagccatttgatattgaccctgcgcatgacatcgccgtgcttcaatacacgggcggaacaaccggctatccgaaaggcgtcatgctcacacaccgaaacattcaggccaatacagaaatgtgcgccgcctggatgtacaaaatgaaaaagggagccgaaaaggtgctcggcatcgtgcctttttttcatgtgtacggattgaccgccgtgctcaatttttccattatgcagggatgtgaaatgatccttcttcctaaattcaatcctttggatacactgaaaacaatcgacaggttgaagccgacggttttccccggggcgccgacgatttacatcgggctgctgcatcacccggagctgaataagtatgatctgtcctccattgaaagctgtccgagcggttcagcggcactgccggttgaggtcaaacagaaatttgaaaaagtgaccggaggaaagcttgtggaaggctacggattatccgaagcatcaccggttacccattcaaacttcatctggggaaaaaataaacccggcagcatcggctgtccctggcccaataccgatgcgggaatctattcagaagaaaaaggcgggcttgcggagccgtatgaacacggcgagctgatcgtaaaaggccctcaggtcatgaaaggctattggaataagcaggaggagacggcgcgtgtcatcagagacggctggctgtttaccggagatatgggatatatggatgaggaaggatttttctacatcgccgacaggaaaaaagacatcatcattgccggcggatacaacatttacccccgcgaggtggaggaggcgctttatgagcatgaagccgttcaggaaatcgtggtagcgggcgtccctgattcctacagaggggaaacggtgaaagcatttatcgttttgaaaaaaggcgccgaggcagatgccgatgagcttgatgcgtttgcaagagagcggcttgcgccgtacaaagtcccgaagctgtacgaattcagaaaagagcttccgaaaacggccgtcggaaaaatattaagaaggcgtttagtcgaagaggaagatgcttcccatgaaaacaaggtgccttaaaagaaaaacttgacaaaatccggattcctttttatcatgaagttatgaatgaatagtcattcatttatcgaaggaaggaacgatgacattgaaccaaaaacggccaaagtatatgcagattattgatgcagcagtagaagtcatagcggaaaacggctatcaccaatcacaggtgtccaaaatcgccaagcaggccggcgttgcggacggcaccatctatttatatttcaaaaacaaagaggatatactcatttctctttttaaagaaaagatgggccagttcattgaacgcatggaagaagaagtgaaagaaaaaacgacggcaaaagaaaaactcgctctcgttattaagcagcatttcacactgctcggcaatgaccgccacctcgcgattgtgacccagcttgagctcagacagtcgaatatcaagctgcgtctgaaaatcaatgatattttaaaaggttatttaaacatgctggacaccattttgaccgaaggaatcgagtcgggcgaatggaaagataatctcgacgtccgcctcgcccggcagatgatattcgggacgatagatgaaacagtgacaacatgggtgatgaacgatcagaaatatgatcttccggatttgtcagacaaggtattggagctgttggtgtcagggattcatcaaaactaaagggggttgacggatgaacagcctttcgatggcggtagaacaatctgttgcggtgatcaccattaatcatcagccggcaaacgcgctgtccggcgcggttttagatgagttgtccggtctgttcgaccgctgtgaaacagatgacagtgtcagaagcatcatcattcgcggagaggggaaatttttctcggcgggcgctgatataaaggaatttacgtcgcttgaaaatcttgagcaatcttctgccatggcggataaaggccagcagctgatggaaagaattgaagggtttccgaagcccgttatcgcagcgattcacggcgctgcgctcggcggcggccttgagcttgccatggcctgccatatcagaatcgctacattagatgcaaagctcggcctgcccgagctgaatctcggcattattccgggctttgccgggacgcagcggcttccccggtacgtcggtacggcgaaagcgcttgaaatgatcggcacttcagaacctgtaaccggagaagaagcgctcagcctcggtcttgtcacgataggcgccgaacatgaggaagagctgctgcaaaaagcgaaaacgctcgcgggcaagtttgcggaaaaaagcccgcagtcgatggcttttctgcttgagctcctttattcaaacaaggtctattcttatgacggcggcttaaagcttgaagcaaagcgctttggggaagcatttgcatcagatgacgcaaaagaaggcattcaggcatttctcgaaaaaagaaagcctcaattcggtgggcgaagataaaggggataagaatatgaatctatttgtactgatgaaacggacgtttgacacagaagagaaaatcgtcattgaagcaggaaagattcaggaggacggggccgaatttatcattaatccgtatgatgaatacgccattgaagaagccattcagctgaaggaagagcacggcggaaccgtgaccgccgtaaccgtcggcggagaagatgcggagaaagaactgagaaccgcccttgcgatgggctgtgaccaggcggtgttaatcaatattgaagatgatctgagcgatcctgaccaatactccgtttcaactatcttatatcattatttcaaggaccgggaatatgatctgattctcggcggaaatgtcgcgattgacggcggttccggccaagtggctccaaggcttgccgaactgctgaacattccttgcgtcacaacgattacaaaactgacaatcagcggcgatgaagctgcggcagagaaagacaacgaaggggataccgaaatcattaaaacctcacttcctttagtcatcacggcacagcaaggcttaaacgagccgcgctatccgtcgcttccgggcattatgaaggcgaagaaaaaaccgctggaagaacttgagctcgatgatctcggcattgatgaagatgatgccgcaccgaagctcaaaacgatcgaacgttttctgccgccgcaaaaagaagcgggcagactgatcgaaggagaagcctctgagcaggcgaaggagcttgtatcactgctgagaaaagaagccaaagtcgtataaactgatattaaagaaactgggggatgtcagaatgggaaaaaaagtgatcgtactcggagaaattcgtgacggcgccttacggaacgtcacctttgaagccatagccgcaggcaaaaccatttccggcggaggagatgtcatcggcgtgctgatgggaaagggcgcggctgatgcagcatcagaactcattcagtacggcgccgacaaagtatttacggccgattcgccggggctttctcagtatacggcggacggatatgccgcaattctcggggatttgatcgaaaatgaaaagcctgatgcggtcattttcggccacacttctatgggaaaagatttgtcacctaagcttgcggcccggtttgaaacggggctgatttcagacagcacagatgtaagcgttaccggagataacatcgtttttacaagaccgatctattccggcaaagcctttgaacaggtgatttcaaccgatcctttcattctggcgacaattcgtccgaataatattcaggcattagaaaaagacgcgaaccggacgggtgatattgaagagcttgcggcgcctccggcagatttgcggacggtcattgaagaagtagtcaaaaaaacggcggacggcgtggatttatcagaagcgaaaattatcgtagcaggcggccgcggtgtaaaaagcaaagatggatttgaaccgttaaaagaacttgccgaggtgctcggagcagcggtgggcgcttcgcgcggcgcatgtgacgcggactactgcgactattctcttcaaatcggccagacgggaaaagtcgtcacgccggatttgtatatcgcctgcggaatttccggagcgattcagcatttggcgggcatgtcaaacagtaaggtcatcgttgccattaacaaagacccggaagcggaaatatttaaaatagcggactacggaattgtcggcgatttgttcgaagtggttccgcttctgactcaggaatttaaaaatgccaatattcattcataatcaaaaccctctggcttatttgtcagagggttttggtttgtgttaattagttcgtacaaattatagattaataaaacaacagattgacatgtacgaaccaatgtaataagcttttgtaaagcgcttacaaacttatccatacagcatacatcccagatagatcggctgtagtgctttcattcttattaaggggaaggaatgatcaagtttgtctcacaatacggcagtcattcaaactgatatcacacggggaaccattaataaaaacatatacggacatttcgcggaacacctgggaagaggcatatatgagggcatctgggtcggaaaagattccgatattccgaataccggaggggtcaggacggatgtcgccgccgccctcaagcagcttcagattcccgtcctcagatggccgggcggctgttttgctgatgaataccattgggcaaacggcgtagggaaacgcaaaacaatgctgaatacccattggggcgggacgattgattctaatgaattcggcacgcacgagtttatgatgctttgtgaactgctcggatgcgaaccgtacatcgccggtaacgtcggcagcggaacggttaaagaaatggctgattggattgaatacatgacgtttgaagcgggcacgccgatgtccgactggagaaaagaaaacgggcgggaaaaaccgtggaagctgaaatatttcggaataggaaatgagaactggggctgcggcggaaacatgcatcctgagtattatgctggcctttacagaaacttccaaacctatgtccgtaattacagcggtaatgaaatctataaaattgccggcggcgcgaatgtcgacgattaccgctggactgaaactttaatgaaaaaagccgcggatctcatagacggactgagcctgcattattacacaataccgggcgacttctggaaggggaaaggatcagcgacggagtttacggaagatgaatggttcatcacgatgaaaaaagcggcgcatatggatgaattgatcacaaggcacagcgccatcatggatcagtacgatcccgaaaaaagagtcgggctgatcattgatgaatggggcacgtggcttgatcctgagccgggcacaaatccgggctttctgtatcagcagaatacgatccgcgacgcccttgtcgccgccgcgcattttcacatttttcatcagcacgcagaccgcgtacagatggccaatatcgcgcaaaccgtcaacgtgcttcaggcaatgatcctgacagaagggaaagaaatgctgttgacgccgacgtatcatgtgttcgatatgtttaaggtgcaccaggacgcatctcttttggcggcagaaacaaatgcagccgggtacgaatggaatgacggccggctcccgcaagtcagcatttcagcgtccaaacagcagaacggagacatacatatcagcatttgcaatatcgatcatctgcacaaagctgacgtgaagattgaactgcggggcatgaaaaagacagggacgccttcgggaacgattctgcacgcggaaaaaatgaatgcccacaatacattcagcagtccggaaaacgtcaaaccgaagccgttttccgggtttgctcaaaagggaggaaaacttgaggcggagcttcctccgatggcgattgtattaatcacgctgcctgcaggtccatcttaagttttgaacgcccgccgcccggttataatacactgtataaataagattatttccggcgggttcgggggaaaataatataagcattaaattagcatgaacgaatgggagatgctatactaaaaatcatcatttgacaattggaggaataacaaatggctatcgtaaaagcaactgatcaatcgttctcagctgaaacaagtgaaggtgtcgtattggctgatttctgggctccttggtgcggaccttgtaaaatgatcgcgcccgttcttgaagagcttgatcaagaaatgggagacaaactgaaaatcgtcaaaatcgacgtggatgaaaaccaagaaactgccggtaaatacggcgtcatgagcatcccgacacttctcgtgctaaaagacggagaagtcgttgaaacatctgtcggcttcaaaccgaaagaagctcttgaagagcttgtaaacaaacatctgtaagccgaaagcttccgttacggcagggcgattcctttgaaaggggtcgcctttttttgatcttccaaaagctgagaatggagaaaaacaaatgttcgtgatacactgaatggacacgagaaatgaatgtaaggaagggtaacgtatggataaacaactgaaagaaaagctggccctccttcccgatcagccgggctgttatttaatgaaagaccgtcagaaaacagtcatctacgtggggaaagcgaaagtcttgaaaaacagggtgcggtcttatttcaccggttctcacgacgcgaaaacccaacggctggtgacggagattgaggactttgaatatatcgtgacttcctccaatcttgaagcgcttattttggaaatgaatctgattaaaaaatacgatccgaaatacaatgtcatgctgaaagatgataaaacctatccctttattaaaatcacccatgaacgtcatcctcggctgattgtcacccggaatgtcaaaaaagacaagggacgctatttcggcccgtatccgaatgtgcaggcggcgcgggaaacgaaaaaactgctggaccgcctttacccgctcaggaaatgctcaaagcttccggaccgcgtctgtctttattatcatctcggccaatgcctcgccccatgtgtaaaggatatatctgaggagacaaaccgcgagattgttgaagacatcacccgttttttaaagggagggcataacgaaatcaaaaaagagcttgaagcgaaaatggcagaagcggccgaaaagcttgaatttgaacgggctaaagaattccgcgaccagcttgctcacatcgaatcgacgatggagaagcagaaaatgaccatgaatgaccttctggaccgcgatgtgtttgcatatgcctacgataaaggctggatgtgcgttcaagtcttttttatacgccaaggaaaactgatcgaacgcgatgtcagcatgtttccgatgtatcaggaagcggatgaagagtttctgaccttcatcggccagttctattccaaaaacaatcactttctgcctaaggaaattctggtgcctgacagcgttgacagggacatgattggcgagctgttggaaaccgccgtgcatcagccgaaaaaaggtccgaaaaaagagctgcttttgcttgcgcacaaaaatgcgaaaatcgccctgcgggaaaaattctcgttaatcgagcgggatgaggaacggtcaatcggtgcagccgaacggctcggcgaagcactgaatatttacacgccgcatcggattgaagcgtttgacaactccaatattcaaggcacaaaccccgtatcggccatgattgtctttattgacggaaaaccgaataaaaaggaatatcgcaaatataaaattaaaaccgtaacagggccggacgattacggctcaatgagggaagtcgtcagaagaagatacacgagggtgctccgcgaaaatcttccgctgccggatttaatcatcattgacggcggaaaagggcagattaacgcggcgcgcgacgtgctcgagaatgagctcggccttgatgtcccggtagcgggactggcgaaagatgataaacaccggacatcgaaccttttgatcggcgacccgcttgaaccggtgtttctggagcggaacagccaagagttttacctgcttcagcgcattcaggacgaagttcaccgttttgcgatcagctttcacagacagatccggggaaaaagcgtctttcaatccgttctggatgatatccccggaatcggcgaaaaacgcaaaaaaatgctcttaaaacatttcggatctgtcaaaaagatgaaggaagcaagccttgacgatatcaaaaaagccggtgtgccggccgcggcggcccagttgctgtttgaaaaattaaaaaaatagtattgtgcttttctgaaaaatctgctagaatgtgaactaatttcataagatcgtgttatatggtgaagatagaggtgcgaacttcaatagtaagcctttggagaatgatggattctgcgaaaaaggctgaaaggggagcgtcgccgaagtgtgtcacatcccatcggtgtgatttgctggccttgcattaaataaatgtaaggctgtcaagaattcattttcttggagggctatctcgttgttcataatcaatcgtactgatatgaaaagcaatgagagctattcctctcattgctttttttattgtggacaaaacgctcttttctcctcacccgcacgaaccaaaatgtaaagggtggtctagtatgggtcttatcgtacaaaaattcggaggcacttccgtcggctctgccgaaaaaattcaaaatgccgcaaatcgcgccattgctgaaaagcaaaaaggccatgatgtcgtagtcgtcgtttcggcaatgggaaaatcaaccgacgcgctcgttaacctcgcggctgaaatcacatctgaaccaagcagacgcgagatggatatgcttttgtctacgggggagcaggtcacgatttcgcttttggccatggcgcttcaggaaaaaggatatgacgccgtctcttatacgggctggcaggcgggtgtccgcacggaagccgttcacggcaatgcgagaattacggatattgatatcacggcgattcgttcgcagcttgcagaaggcaaaattacagtcgttgccggttttcagggcgtaacggaagacggcggcatcacgacgctcggacggggcggttctgataccacggcggtcgctcttgcagcagcgctggaagcggataaatgcgacatttatacagatgttccgggcgtatttacgacagatccgcggtatgtccggtcagcgagaaaactggcggggatttcttatgatgaaatgctggaacttgcaaatctcggagcgggtgttcttcacccgcgggcggttgagttcgcgaaaaactaccaagtgcctttagaagtgcggtcaagcacggaacatgaagccggaacattaattgaggaggaatcatcaatggagcagaatttaatcgtcagaggaattgcatttgaagaccagatcacaagggtgtccgtcacgggccttgcaagcggactgacaacactttcaacaatcttcaccgcgctggcaaaacgaaacatcaacgttgacatcattattcagacacagtcggatgatggggaagcggatatttctttctcagtgaaaacggaagatgccgcccaaacggtcgccgtgcttgaagaatataaaaacgcgcttaactatgaaaaaattgaaaccgaaagaaaactggcgaaagtctccattgtcgggtcgggcatggtttcaaatcccggcgtcgccgcggacatgtttgccgtactggcggaaaaaaatgtacaagtcaaaatggtaagcacatccgaaataaaagtatcagcggttgtcagcgaaaatgatatggtgaaagcggtcgaagcgcttcatgatgcgtttgagctgtctaaacagccgtctgccgtataaacgggcaggcaaaaaggcgggacttttgagtcaccgcctttttcaattatacagggtccttcatatcccattttacagtcaggacgactttatccgctctcttttttacctgttcataagattctgcaatctgatcgttcatcaattgaatctgttcggctataaaaccggcttcaagctggaaacaaggctctttctgatgtttgagcctgctggatacgagcggtccttccagttcaaattccagttcttgttttttcgatcctgcgtttgtcaaagttccccagccggctttttcaaaaaaggcggggatttcttcccacgattgaagaggaaatttgcgggcgaggcgttttcccgcccaatacatcatcgatgaatgatccggaccgaggatatccggaagcacgatttcccggattaattcgtagccgtatgcgctgacgtcgagttcagttaaaggttctaaagctgcttcataattattcttcatattatgtattcccctctctccttcgtttattatagcttaaacaggggggaggattacaggatgatcctataaaacacgcgaaaaaatgtgagaaagatatcgcaggaaaataaaattttccctccagataatcaattccgaaaattataatttatgtacacgttttcttgacgcccttttgagggaggagtaaaatgaaattgtcaataaattttaataaagtgcttacaattgaaacgaagtgggggcagagattttagtacatttcgcacttaaatcaaacagggggtaaagtaatgtctgggaacagagagttttattttcgaagattgcattccttgctcggtgttattccggtcggcatctttttgatccagcatttagtcgtcaaccaatttgccgcaaggggagcggatgcgtttaacaaggcggccggctttatggacagtctgccgttcaggtatgcgttagaaatttttattattttcttacctttaatttatcatgcggtttacggtgtgtacatagcatttactgcgaaaaacaacgctggccactacagttatttcagaaactggatgtttgtgcttcagcgtgtcactggtattctcacccttattttcgtcagctggcatgtgtggcagacgcggattgccgcgcagatgggcgctgaagtcaacttcgatatgatggcgaatattctgagctcgccgtttatgctcggtttttacattgtaggcgttttatcggtcattttccacttttcaaacggcttatggtcttttgcggtcacatgggggatcacggttacgccgcgttctcaaagaatttcgacttacgtgacgctgattatatttttagcgctttcatacgtaggtttaaaagcgatttttgcgtttgtgtaagagaactagattactagagggagaggggctatcatgagtcaatcaagcattatcgtagtcggcgggggtctagccggcctcatggcgacaattaaagcagcggaatcaggcacggccgttaaattgttttccatcgttccggtcaaacgctctcactcggtctgcgcgcagggcgggataaacggagctgtcaacacaaaaggggaaggagactctccgtttgagcattttgatgacacggtatacggaggcgactttttggcaaaccagcctcctgtaaaagcgatgtgtgaagcggcgccgtccattatccacttattggaccgcatgggggttatgtttaacagaacgccggaagggctcttggacttccgccgtttcgggggtacacagcatcacagaaccgcttacgcgggagcgacgacgggtcagcagcttctttacgcactggacgagcaggtgcgcagatatgaagtggcgggtctcgtcacaaaatacgaaggctgggaattcctcggcgccgttcttgacgatgagcgcacgtgccgcggtatcgtagcccaaaatctgaccaatatgcaaatcgagtcattccgttctgacgccgttattatggcgacgggaggacccggaatcgtattcggaaaatcaacaaacagcatgatcaatacgggatctgccgcatcaatcgtctatcagcagggcgcttattatgcaaacggcgaatttatccaaattcacccgacagcaatcccgggggacgataaactgcgtctgatgagtgaatcggcgcgcggcgagggcggtagagtctggacgtacaaagacggaaaaccttggtacttcctcgaggaaaaatatccggcttacggaaacctcgtgccgcgggatattgcgacacgtgaaatctttgacgtgtgcgtgaatcagaaactcggcatcaacggagaaaacatggtgtatctcgatctgtcgcacaaagatccgaaagagcttgacgttaagcttggcggcattatcgaaatctatgaaaaattcatgggcgatgacccgcgcaagcttccgatgaaaattttccctgccgttcactattcgatgggcggactgtgggttgattatgatcagatgacaagcatccgcggactgttcgcagcgggtgaatgtgattattcaatgcacggaggaaaccgtttaggggcgaactctctgctttccgccatctacggaggaatggtggccggaccgaatgcggtgaaatatgtttccggacttgaaacatcagcggaagacctgtcttcttcattatttgattcctatgtgaaaaaagaagaagaaaaatgggccgatatcatgaagatggacggcgatgaaaatgcctacgtgcttcaccgtgagctcggagaatggatgacggccaacgtcacggtggtccgccacaacgacaagcttttgaaaacggatgacaaaatccaagagctgatggaacgctttaagaaaatcaatatcaacgatacgacaaaatggagcaaccaaggggcgatgttcacccgccagttctccaatatgcttcagcttgccagagtcatcacgctcggcgcatataaccgaaatgaaagccggggagcgcactataaaccggatttccctgaaagaaatgacgatgagtggctcaaaacgacgatggctaaacatgccggtccgtttgaagctccggaatttgaatatcaggatgtcgatgtatcactgattgcgccccgtaaacgcgactactcgaagaagaaggtggcgaaataatcatgagtgagaaaaagatacggtttatcattacacgccaggatacgcccgaaagcgcgccatacgatgaagaattcgaaatcaattaccgcccgaatctgaacgtgatttccgccctgatggaaatccgcagaaatcccgtgaatgcaaaaggagagaaaaccactccggtcgcatgggacatgaactgtcttgaagaagtatgcggcgcctgctccatggtcatcaacggaagaccgcgccagtcgtgtacggcgctgattgataagctggaacagccgatccgtctgaagccgatgaaaacattcccggttgtccgtgaccttcaggttgaccgcagcagaatgtttgattcactgaaaaaagtgaaagcatgggtgccgattgacggaacttacgatttggggccggggccgagaatgccggaaaaacgccgccagtgggcatatgaattgtctaaatgcatgacatgcggcgtctgccttgaagcctgcccgaacgtcaacagcaagtcgaaattcatggggcctgccccgatgtcacaagtgcgtctgtttaatgcccatccgacgggcgcgatgaacaaagcagaacgtttagaagctttaatgacagacggcggcctcggagattgcgggaattcacaaaactgtgttcaatcctgcccgaaaggcattccgcttacgacttcaatcgctgctttgaacagagataccaatttacaagcattccgtaatttcttcggaagcgacagagtataagaaagagaaaaagagcctcttccgcacgggagaggtttttttataaggagctgaaggtgatgaaacaaccgcaatatattgatatcccgtttgaagaatggagacagtcgttttctttctttactgaagtatcggttcgtttttcagaaacggatatgttcggccatatgaataatgtaacccctttcatctattttgaagaagcacggatcgcttattttaaacagcggggcatgacggcgcaaaactcggaaacgatgacggtcgtcgcaagccagcagtgcgactatatgcgtcaggtgatgccgtatgaaaatctgcggatttatgtgaaagcaagcgctgccggaaatgcgtccgtcacccttcattaccttggagaaaatgagtcgggcctgccgtgctttacaggttccgtcgttatggttcaagtgtcgaaaaaaagcggcaaagcggtcagctggacggagcgggagaaaggcattctgctcgcctgaacggataactatttctctaagagacgtcacctccgaagcgccctttacatatgatatcttgactatataaacccattcgtttcagattcgctctcaccttagcaaggagggttacaatacttgaaggagaaagattttcaatcaaagccgctgctgaccaaaagagaaagagaagtattcgaattgctcgttcaagacaagacaacaaaggaaattgcaagcgagctatttatcagtgaaaaaactgtacggaatcacatttcaaatgccatgcagaagttaggtgtgaaagggcgttcgcaagctgttgtcgagcttcttagaatgggtgagctagagctctgattcttgccggttttccttctttacgagaaggagccggttatttgcgttggcgcccgggctgatgggcatgcggtgaaaatcccggtttttcctttttctccgtcagtcttgcattttcttaaaaaaagaaggaaaatagacacggagcgcatagcccagaaagatccttgagtgagggatggacaaatgacatcaaaatctgtagagcatgttgcggatatcgaaaaatcactccgccatatcgctgcgatcattaaacaaaaaggaagagaaatccttaaccaatatgcaattacaccgccgcaattcgtggggcttcaatggctttatgaattgggggatatgacaataggcgaattatcaggcaaaatgtatttggcttgcagcacgacgacggatctgatagaccgcatggaaaaaaataagcttgtcgagcgggtcaaagacccggctgacagacgggtcgtcagaattcatcttctcgctgaaggagagcgcattatccaagaagtgattttgaaaagacaggcttatttgcgggatatgtttgcgacattttccgaagaagaaacagccgctttcgaaaaatcattattgaaactgcagcatgaaatgaaaagaaaatgaggcgattttgttggaacagccgataggagtcattgattccggggttggcgggttaaccgttgctaaggaaatcatgagacagctaccgaaggaaaatatcatctatgtgggagatacaaaacgctgcccgtacggcccgcgtcctgaagaagaagttcttcaatacacgtgggaaatgaccgattacctgctggaaaaccaccatatcaaaatgctcgtgatcgcctgtaatacggccacggccattgccttggaggatattcagcgcaaaacggatattccggttgtcggcgtcattcagccgggtgcgagaacggcgataaaggtcacgaaaaaccagcatatcggcgtcatcggcacggtcaataccattaaaagcagagcgtatgagcaggcgctgctcgggttaaacgcagaacttcaagttgagaacacggcttgtccgctgctcgtgccgtttgtggaaagcggacggtttcttcaggaatcagcggaggaagcggttgaagcatcgcttgaacctttaaaaggtacatcaattgacaccttgattttaggatgtacgcattatccgatcttaaaagacccgattcagaattatatgggagagcatgtgaaaatcatttcctccggagacgagacggcgagagaagtgagcaccatcttgtcttataaaggtttgttaaaccaatcgaaacatgcaccggagcatcaatttcttacaacgggagagcggaacggcttcgcaaaaattgccgaagactggttcggccacgaaatcggccatgtcgagtgcatctcccttcaagagccggtcagaaaataaatcaaaaaaaccccgctgtttacagcgggtttttttgcgcttcccggtctatttcccggacagggctcgtatacatcatagtacaaacagccttaggagggaaaagtatgctgaaaaaaggacctgcagtcattgctgcaacatgtcttacttcggcttttgtgttatctggatgcggtttgtttcaatccgataaaacagccggggaaattgacccgcctcaagacatttcatatgtaaaggatgaagcgggaattcaggcaaaaccaaagcagtcagagaaaaacggcacttctaaagccgaccagccggccaatacagtcatgcgagaactgtatctgattgataaaaacggctatgtcgcagcacagacactgcctcttccgaacagtgagggaaccgcaaagcaggcccttgagtacttggttcagggagggcctgtatcagaaatcctgccgaacggcttcagagcggtgctccctgcggatacgacggtaaatgtcgatattaaaaaagacggcactgcagtcgctgatttttcgaaggaatttaaaaactataaaaaagaagacgaacaaaaaatcctgcaatcgattacgtggacgcttacccaattcagctcaatagataaagtcaaaatcagaatcaacgggcacgaactgaaagaaatgcctgtgggcggcacgccgattacgggcgacttaagcagaaaagacgggattaatattgaaacggccggagtgaatgatctgacagacacccatccgctgactgtatattatctggcggaaacagagacaagcgaatactacgtgcctgttacaaagcggattgacaattcggaaacaaatgacatcaccgctgccgttgaacagctcaccgacggaccgggcaaagcaagcgggcttttgacggactttaataacgatgttaagcttctcagcaagccgaaagtgaaagacggccaggttacactggactttaacagctctatttacggaagcgccgacgaaaaaacaaaaatggtgtcatcgggcgtactggacagcatcgttctcacgttaaccgaacagccgtcgattaaaagtgtttctataaaagtaaacggaaaatcagaactggtgaatgaaaaaggagaatccctttcaaaacctgtttcgaggccggcacaagtgaatacgggtagtttttaatttgcgatttttgatatactagtaaaaaagaggttagcgttccggctgcctctttctttattcacaatccggaacaaaaggtttatgtacatataatcggaggtaaaatatgagacacgacggaagacagcacgatgagctgcgccctatcacatttgatttggattttatcactcacccggaaggctctgttttaattacagcgggaaatacaaaggtcatctgtaatgcatctgtggaagaccgggtgccgccatttttacgcggcggaggaaaaggctggatcacagcggaatacagcatgcttccccgcgcgacgaatcaaagaacgataagagaatcttcaaaaggaaaggtctccggcagaacgatggaaattcagcggctgatcgggcgcgcgctccgggccgtcgttgatttggagaagctcggcgaacggacgatctggatcgactgtgacgtcattcaagctgacggcggaacaagaacggcttccattaccggcgcattcttggcaatggccattgcgaccggcaaactcgtaaaaagcggcgttatcaaaacctctcccgtgacagattatctcgcggccatttctgttgggatggataaagaagaaggccttcttttggatctgaattatgaagaggattcggcggctgaagtcgacatgaatatcatcatgacgggaagcggacgttttgtagagcttcaagggacgggcgaagaagccacattctcccgtgaagatttaaacggactgttaagccttgccgaaaaaggaatccagacgcttattcaaaagcaaaaagaagtgctgggagaaacattgcctgaactgaaataagaaagagaggcctgatcagcgtgaaagaagtcattattgcgacacacaatcagggaaaagtgaaagaattcaaggaaatactcgaaccgaaaggctacagcgtctcttctttggcggaaatcggatttacggaagaaattgaggaaaccggacatacctttgaagaaaacgccatcttaaaagcggaagccgtggcaaaagccgtcaacaaaatggtcattgcagacgactccggtttatcagtggacaaccttggaggcagaccgggcgtttattcagcccgttatgccggagaagcaaaagatgataaggcgaatatggacaaggtgctgtcagaattaaaaggcatcgaaaaagagcagcgcacggcccgtttccgctgcgcccttgccgtcagcatgccggggcaggaaacaaaaacggtcgaaggtcatgttgaagggtatattgcagaaggacccgaaggagataacgggttcggctatgatcccatttttattgtaaaagataaagataaaaccatggcccagctgacaagcgctgagaaaaacaaaatcagccacagggctgaggcgctcaagaaactgtcaaagctgcttgattcataagggggagcgtatgcaatgaaagtgctgataataagtgacagtcacggccttgaagacgagctggagacgattgcaaagcggcacgaagacgaagcggatctgatgattcattgcggtgattcagagcttgacgccgcacatccggcactcacgccgtatcacaaggtgaaaggcaattgcgactttggcggcgggtttcaggatgaactccttctggatgccggttcaaagaaaattctggccgttcacgggcatcttcacggcattaaacagtcacttttaactgttttttaccgggcggaagagcttggggcggatatcgtctgcttcggccattcacatattgcggggagtgaagtgcttcggggcaagcttttgattaatccgggcagcatccgtcttccgagagtccgcaatgtgaaaagctatgccattcttactcttacagaaagagaaggcgccgtgacattttacgacgaaacgggtcgggaattgaaggacttggggaatacaatcagtttttaacaagtgatgggggagatttcattcttccccatcaaaagttttttaaaaaatattgacttatgatttgaacctgtatataataaatcttgtcgctgatacataaagcaaaagctgtcccagtagctcagctggatagagcaacggccttctaagccgtcggtcgggagttcgaatctctcctgggacgtacaaaaaaagagctggtgacatcagagtgaaaactgatgccgctggccttttttatcggatgactatattgtcaattcactgatatcatggtaaaataatcagcagatatttgtttttcatgtcccagtagctcagccggatagagcaacggccttctaagccgtcggtcgggagttcgaatctctcctgggacgtataaaaaacctcaagccctgacaatgggtttgaggtttttttgtattttatttttagttttacgaaacaaaagttccgtatttgatgaaaattgtaaagtaattttaatgtaaatgaaacttaatgtaatatttaccgtaataaatatatgtataaagatacttaaggcgcccttgagtgataaattatctgatttctatcatacgttttgttgatgattgatagaaagacagcaggaggaattagcttttgaagtacgcatttgcatataaaaatcacaatatagaaacgatcttttgcggaaaagacgagctgtttgaggaactgaaacaatttttaatcactcaatgcggtttaatcattgttgaggtttcaagggctgattactatacggagcaggaaatgaatcagtggaatgaacgttatactctgtgaataagaaaagaaaccggccgtgtgagaccggtttttgtatcatctgaatccgctcggagcgctgaagcccccggcatggccgctgaaaccgccaccgagcgcgccgggatgtgccccggcgccgaggcttccgccgacgtcactgaaggtttggccgtagtacccggatgtataagggtacggaacgaattgctgtccggcgaatgacagtgtgctttgcggggtctgctgtccgtatccggatggcggaaatccctgctgaaaagaagggccgccttgatatggtgctgtatgcatcggggccggaggatagtaagactgcggcggtaagaccggtaaaggcggaaatccaggaggcaggccctgcatgcctgataacatcttattcatgacatcactcatttcttacgagataagaacagtgtatgcgtatgtctgtataaagagcctgttcaatcgaacggaatatctgacaagcatgccggaaggacagagaaaaatcgcgtaataaaatgtgacatattcgtatatgaacggaaaaatttcatgtaatcttgagagattaataaaaaaaatataaaaacttttaacatttgccgatccttttatatcagtaatgaaagcgtatacaaaatagattgattaatctaaattgtctaataattataaaaatgctgttgacactgtctgcaaacgggcgtaatatgagttcaaacaaaaataaataaatgattcacactaaaaagaaaaatcataaaacactgaaaaaacaaacaaatgaaggttcttttttaataaaagagctgccataataaaaagcgcagaagaggataagtagctttgctgaagtttttcacagagagccggtaacgctgagagccggtaaaacaaatcaaagtgaactcccctcagagtgccggtctgaaatgtaaagagtaggactcggccgagtgaacgcaatgtttactcgttatcaaaacggataatcattatccatgagacggtctgcatatgaccgtaaacaagggtggtaccgcggagagcaaagccttttcgccccttttggctatcgcatgaaatgcttggctgaatgtgggtgggaaggcttttttatttgcgtcagccggcgctgcgttttatgaattggattttagaagggaacattgaaaaggaggaactgaaaatgggcacaaatgtacaggcggattctttgtctgccgattgtacaaaaacaatgaacggggctctgatgctgattgaatcattaaagaaagaaaatgtcgagatgatcttcggctatccggggggagccgtccttccgatttacgataaactgtatcaatcaggattggttcacatcctgccccgccacgagcaaggcgcgattcatgcggcagaagggtatgcgagagtctccggaaagccgggggttgtgattgctacctccggacccggagcgacaaatttagttaccggtcttgcggatgcgatgattgattcactgccgctcgtagtgtttaccggtcaggtcgccacttcggtcatcggcagcgacgctttccaggaagccgacattttaggaattacgatgccgattacgaaacacagctaccaagtccgccgtccggaagatctcccccgtgtgattaaagaggcgttccatattgccacgacgggaagaccgggcccggtattaattgatataccgaaggatgtcgcagcatttgaaggagaattcagatatgatcacgagatcaatcttccgggttatcagccggtaaaagagcctaactatctgcagatccgaaagctcgtggaagctgtcagcagtgcgaaaaagccggttattttagccggagcgggtgttttgcacggtaaagcttcagaagatttaaaaaattatgccgaacagcagcaaattccggtagcgcacacgcttctcggtctgggcggtttcccggcagaccatcctctttttctgggaatggcggggatgcacggcacatacacagcgaatatggcgctttaccactgtgacttgctgatcagcatcggagcgcggttcgatgatcgcgtgaccggaaatctgaagcattttgcaaaatcggccaaagtagcgcatatcgatattgatcctgctgaaatcggaaaaattatcgaaacgcagattccggtggtcggcgacagtaaaatcgtccttcaggaattattgaagcaaaacggaaaacagggacagacagaggaatggaaacagcagctttcagaatggaaagaagaatatccgctttggtatacagacgacagagaagagggcttgaaaccccaaaagctgattgagtatattcaccaattcacaaacggtgaggcgattgtggcgacggatgtcggccagcaccagatgtgggcggctcagttttatcctttccgaaaggctgataagtgggtgacctcgggggggctcggcacaatgggcttcggccttccggcggccatcggagcgcagctggccgatcgtaacgccacggtcgttgccatcctcggagacggcggttttcagatgacccttcaggaattagatgtcatccggcagctgaatcttcctgtcaaagtggttatcttgaacaacgaatgtctgggcatggtcagacagtggcaggaaatcttctatgaagaacgctattctgaatccaaattctcggcgcagcctgactttgtcaaattgtcagaagcctacggcattaaaggcgttcggatttcatcggaagaagaggcggaagaagagcttaaaaaggcgctttcatcaaaagaaccggccgttattgacgtccgggtcgccaaaagcgagaaagtattcccgatgatcgcgccgggtaaaggacttcatgaaatggtgggggtgaaaccttgaaacgcattatcacattaacggtggtcaaccgctcgggggtattaaaccggatcaccggcctgtttacaaaaagacactataatatcgaaagcatcactgtaggccacacggaaacaagcggtgtttcaaggattacatttgtcgtccatgtggaaggcgaaaatgacgtagagcagctgacaaagcagcttaacaaacaaattgacgtcctgaaagtgacggatattacaaaccaatcgattgtacagcgtgagctggcattaatcaaagttgtttccgcaccgtcggccagaacggaaatcaatggaatcattgagccgttcagagcttccgtcgttgatgtctcaagagacagcatcgtcgttcaggttaccggcgaatctaataaaatcgaagcgctcatagagcttctcaaaccttacggaattaaagaaatcgcgagaacgggcacaacggcttttgcgaggggaacccagcagaaggcgtcatccaataaaacaatttcaattgtataacacaaaaaagggagagattaaaatggtaaaagtatattataacggtgatatcaaagagaacgtattggcaggtaaaaaagtagcgattatcggttacggttcacaaggtcatgcacacgcgctgaacttaaaagaaagcggaattgatgtcattgtcggcgtcagacaaggcaaatcatttacacaggcccaagaagacggtcataaagtcttttcggtaagagaagcggctgcccaggctgatatcattatggttcttcttccggatgagcagcagcaaaaagtatatgaagctgaaatcaaagatgaattgacggcgggcaagtcattggtattcgcacacggatttaacgtccatttccatcagatcgtgcctcctgctgatgtggatgtattccttgtcgcccctaaaggacctggacaccttgtcagaagaacatatgaacaaggcgcgggcgtaccggcattgtttgccatctaccaggatgtatcaggcgaagcgaaagatacggctcttgcttatgcaaaaggaatcggcggagcgcgtgcgggggttcttgaaacaacatttaaggaagaaacggaaacggatttgttcggtgagcaggctgttctgtgcggaggtttaacggcgcttgtcaaagcgggttttgaaacgctgacagaagccggctaccagcctgaactcgcatacttcgagtgtctgcacgaactgaagctgatcgtagacttgatgtatgaagaaggattggcgggcatgagatactctatttccgatacggctcaatggggagactttgtatcaggaccgcgcgtagtcgatgcgaaggtaaaagaatcgatgaaacaagtattaacggatattcaaaacggtacattcgcaaaagaatggatcgtggaaaaccaagtgaaccgtcctcgtttcaatgcgatcaatgcaagcgaaaacgagcatcagattgaaaaggtcggcagacagcttcgtgaaatgatgccgtttgtcaaacaaggcaaaaagaaggaagcggtggtctccgttgcgcaaaattaatgttttcgacacgacccttcgtgacggtgaacaatctcccggggtcaacctcaattcccgggagaaactggcgatagccaagcagcttgaaagactcggggtggacattattgaagcgggatttcccgcttcatcccgaggtgattttttagccgtgcaggaaatcgcaagaacgattaaaaattgttcggtaacagggcttgctcgatctgtcaaaggtgacattgacgcagcctgggaagcgctgaaagacggggtcagcccgcgcattcacatctttatcgccacctctgacattcatctgaagcataagctgaaaatgacgcgggaagaggttaaggaaaaagcggttgaaatggtgaagtatgcaaaagaacgctttccgatcgttcaatggtcggcagaagacgcatgccgcaccgaacttccgtttctggctgaaatcgtagaaaaagtgattgatgccggcgcgagcgtcatcaacctgccggacactgtaggttacctgacgcctgctgaatacggaaacatctttaaatatatgaaggaacacgttccgaatatcagccgggtaaagctctctgcccattgccacgatgatctcggaatggcggttgccaactcactttcggcaattgagaacggcgctgatcaaattgaatgcgccattaacggcataggagaaagagccgggaacgccgcgctagaggaaatcgccgttgcgcttcatgtcagaaatgacgcgcatcaagccgattcatctctcaatcttcatgaattgaagcggacgagtgatcttgtcagcaaactgacgggcatggccgttccccgcaacaaagcaatcgtcggagataacgctttcgcacatgaatccggcattcaccaagacggtttcctgaaagaaaaatcaacatatgaaatcatttcaccggaacttgtcggcgtgactgctgatgcgctcgtactcggaaagcattccggacgccatgcgttcaaagaccgcctgaatgcgcttggattccagtttgatagtgaggaaatcaataaattttttacgatgtttaaagaactgaccgaaaagaaaaaagaaatcaccgatgatgacttgatttctcttattttagaagaaaaagtgacggacaaaaaaatcggctatgaatttctgtctctgcaagtgcattacggaacgtctcaggtgccgactgcaacagtctctttgaaaaatcaggaaaacgaacagctgattcaagaggcggcaacgggggcgggcagcgtagaagccgtttataatacgctcgggcgctgcatcgataaaaatattgaactgacagactaccgcatccaatccaaccggaaaggcgaagacgcgctggctcaagtttatgtcagagtgaccgtgaacggaaaagaaacatcagggcggggaatcgcgcaggatgttctggaagcttctgctaaagcttatctgaacgccgtgaatcggcagttggtgctggattgcaatttagacggattaaagagacggactgcggtcggctcgtaatagaaaggagaacgtttgatttgaaaaaacgcattgctttgcttccaggtgacggaatcggaccggaagtggcggaatcagcggcagatgtattgaaaagcgttgctgaacaattcggacatgaatttgaatttgaaaacgggctgatcgggggagcagcgattgacgcccatcaaaacccccttcctgaggagacggtggctctttgtgaaagatccgacgccatcctgctcggggcagtcggcgggccgaaatgggaccaaaaccctccggagctcagaccggaaaaaggcctgctcggcatcagaaaaaagctcggcctgtttgccaatctgcgtcctgtgaccgtatttgaaagcctgtctgaggcgtctccgctgaaaaaagaatatatcagcggcgtcgactttgtaatcgtcagggaactgacgggcggcctctacttcggagaaccgagcagacagtatgtcaatgaagcgggagaaaaggaagcggtcgatacccttttttataagaaagaagaaatcgcacgcgttgtcagagaagcctttaagatggctgccggcagaaaaggaaaagtgacgtccgttgataaggcgaatgtgctttcttcaagcagactgtggcgtgaaacggcagatgaaatcgcaaaagaatttcctgatgtgacgcttgaacatatgcttgtcgataatgccgcgatgcagctcatctacgctccgagccagtttgacgtcatcgtaactgaaaatatgttcggcgatattttaagcgatgaagcctccatgctgacaggctcgctcggcatgctgccgtcagccagtttatcaagttcaggtcttcacttgtttgaacccgtgcatggatctgcgcctgacatcgccggtaaagggatggccaatccgtttgcggcgattttatcagcggcgatgcttttgagaacatctttcggacttgaaaacgaagcgcaggcggtggaaaaggcggtcgcaaaggtgcttgcagacggcagccgtacacgtgatatcgcccgggacggccaatatgccggaacgcatgacattactgaaaaagtaaaagccgcattagccggctcgaatacaaaatctatagtatgacgctttaaagaaagcggtcttagttcaataggtagagggaggaaacaaagatgatgcctcgaacaatcatcgaaaagatttgggatcggcatgttgtaaaaagcggtgaaggaaaacccgaccttctctatattgatctgcacctcattcatgaggtgacgtctcctcaggcgtttgaagggttaaggcagaagggaagaaaggtcagacggccgcagaacacgttcgcgacgatggaccacaatattccgaccgtcaaccgttttgacattaaagatgaagtcgcaaagcgccaagtaaccgcgcttgaacggaattgcgaggagttcggcgtccgtcttgcggatcttcacagcgcagaccagggaatcgttcatgtggtcgggcctgagcttggtctgacacttccgggaaaaacgatcgtttgcggagacagccatacatcgactcacggcgcgttcggagcgcttgccttcggtatcggcacaagtgaggtggaacatgttctttccacacagacattatggcagcagcggccgaaaacgcttgaaatccgcgttgacggaacgctccaaaaaggagtgacagcgaaggatgtcatcttgtcggtcatcggaaaatacggggtgaaattcggtaccggatatgtcattgaatacaccggggaagtattcagaaacatgtctatggacgaacgcatgactgtctgcaatatgtcaatagaagcgggagcccgtgcgggactgatcgctcctgatgacacgacgattgaatactgtaaaaaccgtaaatacgcgccaaaaagcgaggaatttgaaaaagccgccgcagaatggaaagcgttaaaaaccgatccgggcgccgtatacgatcattccatcgtgttagacggcagcgagatttctccaatggtaacatggggtgtcaatcccggcatggttcttccggtcgatgcccaaatacctgcgccggaaacgattgattctgaagacggtaaaaaagaagccatccgcgcttacgaatacatggggatcgcgccgaatcaaaaaattgaagatattaaagtcgagcatgtgtttatcggctcctgtacaaattcacggatgaccgatcttcgccaggctgcggatatgatcaaaggccgaaaagtcgccgacagcgtcagagccattgtggtgccgggttctcaaagcgtgaaacagcaggccgaggaagaagggctgcaccgcgtgtttctcgaggccggctttgaatggagggaatcaggctgcagcatgtgcctcagtatgaacaatgatgtcgtgcctgaaggggaacgatgcgcttccacttccaaccgcaacttcgaaggcagacagggaaaaggcgcgagaacacaccttgtcagtccggcgatggcggcaatggcggccattcacgggcatttcgtcgatgtaagaaagttttatcaagaaaaaacagttgtgtaaggagtgcgcgaaaagatggaacctttaaaaacgcatacgggaaaagcggccgtcttaaaccggatcaacgtcgatacggaccagattattccgaaacagtttttgaaaagaattgaaagaaccggatacggcagattcgcgttttttgattggagataccttgagaacggtgagcctgatcctgaatttgaattaaaccgcaaagtctatgaaggcgcgtccatattaattgccggagagaatttcggctgcggatcatcccgtgagcacgctccttgggcgctggatgattacggcttcaaaatcatcattgctccgtcatttgccgatatttttcatcagaactgttttaaaaacggtatgcttcccatccgtatgccgtatgatcagtggaaaaaactcgccggtcaatatgaaaatcagtctctaaatatgacggttgatttggaaaaccagctcattcacgacagtgaaggaaaagagatttcatttgaagtcgatccgcactggaaggaaatgctgattaacggttatgatgaaatttcattaacgcttctgctggaggacgacattcagcagtttgaatcgaaaagaagttcatggcttcaagcctgaaaaaagccgcccggcatctgtccggcggctttttttaccgtgtgcatcatcctttcttgtgtttcatgacgcgtgttgatacacttgaacaaaataagcgcctgaaaggaaataaagtatgacgcatgacaagaaaaaagctgatatcattcctttcccccgtctgaaagaacgcttggttgataaagggatggccgccatgaaggataaacagtatgaggaggccctcgaactgttttcagaggcggtaagccacggcgataccgagtccgacgtacatttaggcatggcgatttgttttctggaactcggggaattggaagaagcaaaacaagtttgcgagaaaatgctgaatgaagggtacggccattatttcaccgtattgcaggtgtacatgaccattttaattcagctgaaacaatatgaagaagtcaaaagcacaattgaagctgtgctggaagaaaaccagctgcccgcagaaagtgcggagcaattctaccggctgctcgaattcagccgcaaaatgaccgatcccgatcagcaggaggaggcgtgggaggaggaatacgaggacattcttgatacggaaaaagtgctgaacagccccgctgaacaaatgaatctgattcattctcttaaagaccgcaatattgcaaaatacacgggtctcttaaaaacgattcttcaagatccgggcgcgcatcctcttattaagacaatgattttgacgctgatggccgagcacgactacagtaaaccggtccatattacaaaattcggcgattcaatgaccgcgataccgagtgaaacggtccagcctgatgcggctccgattttgcatcgcgttctccgggtgcttgatgaaacgctgggcaatgaaaaccctacattatatgctgccgtcgaggagctgtggagaagacatctgtacgtcctgcacccttttatgccgaagtttttgaacgcggatttatgggcggcggcgcttcataaggtcggttacgagatgcacggcattgacattgagccggaggaacttcatatgatgtacgagtttgacagccgcgaactcgaagaagcctgcacgatgattaaggatattgaagaaatttcttatttgtaaatcacaccatatagttgaaagcggtaggcgttatgttataatatagtggttgtatttatgtatagcggtttaactgaaatgagaattacggttggacaggctgccagttcattacataatgattctgattcaaagcggttttttctttgacaaagccgcggattgctttagaatggaagaccgacacaacctgaatagatttttggagggaaacacatgtctgtaaaatgggaaaaacaagaaggcaacgaaggcgtattaacggttgaagttgatgcggatacgttcaaaacagctcttgatgatgcatttaaaaaagtagtaaaacaggtttctattcctggattccgcaaagggaaagttccccgcggtttattcgaacagcgtttcggcgttgaagctctttaccaggatgctttagatattttacttcctgtagaataccctaaagcggttgaagaagccggcattgagcctgtagaccgccctgaaatcgatgttgaaaaaatcgaaaaaggcgaaagcttaattttcactgcaaaagtgactgtaaaaccggaagtgaaacttggcgattacaaaggcttaggaatcgaaaaagatgacactgccgttactgacgaagatgtacaaaacgaacttaaagcgcttcaagagcgtcaggctgagcttgtcgtgaaagaagaaggcgctgttgaaaacggcgatacagtcgttcttgacttcgaaggtttcgttgacggcgaagcgtttgaaggcggaaaagctgagaactactcacttgaagtaggatcaggttcattcatcccgggcttcgaagagcagttaacaggccttgaagcaggcgctgaaaaggatgttgaagtaacattccctgaagagtaccacgctgaagagcttgccggaaaaccagctgttttcaaagtgaaaattcatgaaatcaaagcgaaagagcttcctgagcttaacgacgaattcgcaaaagacattgacgaagaagttgaaacgcttgctgaattaaccgagaaaacaaaaaaacgccttgaagaagcaaaagaaaacgaagctgacgctaaattgcgtgaagagcttgttctgaaagcatctgaaaacgctgaagctgatgttcctcaagcgatgatcgacactgagcttgaccgcatgctgaaagaattcgaacagcgtctgcaaatgcaaggcatgaaccttgagctttacactcaattctcaggccaagacgaaaacgcgttaaaagagcaaatgaaagaagatgccgcaaaacgcgtaaaatcaaacctgactcttgaagcgatcgctcaagcagaaaaccttgaagtaacggacgaagaagttgaagcagagctgactaaaatggctgaagcttacaacatgccggttgaaaacatcaagcaggcaatcggttcaactgacgcgatgaaagaagatttaaaagttcgaaaagcaattgattttcttgtagaaaaccgttaatatggttcataataatagacataataaaacagggcgcgattaattcgtgccttgttttgtacaattatgatataactctttttcttggggcaagatagtcattgccgggctgtttttcgtcatacatatagaatgtgcaagtgcgaaacacattgttaccgtcttactggaaagtatggtaaaatgcaatacatactcgatcgtagcaagaaccgttttcttttgcccttcaggtaaaagaaaaagtgagacaagattaaggggtgaaagaatgtttaaattcaacgaggaaaaaggacaattgaaatgctcgttctgcggaaaaacgcaagatcaggttcgtaagctggttgcaggaccgggtgtatatatatgcgacgaatgtattgagctctgtacagaaatcgtagaggaagagcttggtacggaagaagaagtcgaatttaaagacgttccgaagccgcaggaaatccgtgagattctgaatgaatatgtcatcggacaggatcaggcgaagaaatcacttgcggttgcggtatacaaccattacaaacgcatcaattccaacagtaaagtggatgatgttgagctttctaaaagtaatatttctttaatcggaccgactggaagcgggaaaacacttcttgcccagacgcttgcgcgtattctgaacgttccgtttgcgatcgcggacgctacatctctgactgaagccggatatgtcggtgaggacgtagaaaacatcctcctcaagctgattcaggcagcagactatgatgtggaaaaagcagaaaaaggcattatctatatcgatgaaatcgataaagtagcgcgaaaatctgaaaacccgtccattacacgcgatgtatcaggcgaaggcgttcagcaggcgctgctgaaaattcttgaaggaacggttgcaagcgtgccgcctcaaggaggacgcaaacatcctcatcaggaattcatccagatcgatacgacgaacattctgttcatttgcggcggtgcatttgatggcatcgaacaaatcatcaaacgccgtctcggacaaaaagtcatcggcttcggctctgataataaagcggcagacctggaaaaagaagaactgctttctaaagttcttccggaagacctgctccgtttcggtctgattcctgaattcatcggccgtcttcctgtcattgcaagccttgagcagcttgacgaaacggcactggttgaaattctgactaaaccgaaaaacgcactcgtcaaacaatacaagaaaatgttagaacttgatgatgtcgagcttgaatttgaaggcgaggcattatctgaaattgcgaaaaaagcgatcgagcgtaaaacaggcgcacgcggcctgcgttctatcattgaaggcatcatgcttgacgtcatgtttgatctgccgtcccgcgatgatattgaaaaatgtgtcattaccggagcgacagtcgcagacggtgaagcgccgcgtcttgtattaaaagacggtactgttgtcggccaagataaaacatcagcataacacgacaaaacctcctgacccgaattaatcaggaggtttttttcttgtcctgacccttctgaaaatgtttattccgggctttgctgggagatactagcggacagaggaatgaattggatacataaatcgttttttcaggagggaccagcatgagttggacagggatcgcattatttgtacagctgtttttcgggatagtcatcggactatatttttggaatctgctcaaaaaccagcgaacacaaaaagtgacgatagataaagaatcaaaaaaggaaatggaacagctgcgcaaaatgcgcgccatcagtttatcagaacctttatcagaaaaggtgcggccgaaaagctttcaggacattgtcggccaggaagacggaattaaagcgttaaaagcagcgctttgcggaccgaacccgcagcacgtcattatttacggtcctccgggagtcggtaaaacggctgcggcgcggttggtattggaagaagcgaaaaagcataaacagtcaccgtttcaaaagcaggctgtttttgttgaacttgatgcgacgaccgcgcgatttgatgaacgggggattgccgatccgcttatcggttcagtgcatgatccgatttatcagggagcgggtgcgatgggccaagcaggcattccgcagccgaaacagggggctgtgacccatgctcacggcggggtattgtttattgatgaaatcggcgagcttcacccgattcagatgaataaaatgctgaaggtgcttgaagaccgaaaagtatttttagacagtgcgtattacagtgaagaaaatacgcaaataccgaatcacatccatgatatttttcaaaatgggcttccggcggatttccgtttgatcggagcgacaacgagaatgccgactgaaattcctccggccatccgttcgcgctgtcttgaagtatttttccgcgagctggaaaaggatgaacttaaaatcgttgcgaaaaaagcagccgacaaaattcagaaagagatttctgacgaagctctcagcgtgctgaccgcatatacgagaaacggacgtgaagccgtcaatatgatccagatcgctgccggcatggcggtgactgaggacagaaaagaaatcacgactgaagatatagaatgggttgttcattccagtcagctcacacctaaaaatgagcagaaaatcgccgatgaaccgcaagtcggcatcgtgaacggacttgccgtctacgggccgaacagcggcgcattgctggaaatcgaagtgaatgtcacacctgcgcaggacaaaggaagcctgaatatcacgggaattgcagaggaagaaagcatcggcagccaatcgaagtcgatccgccgcaaaagcatggcgaagggatctgtggaaaatgtgctgacggttctccgcacaatgggcatcaaaccttcagactatgacattcacgtcaattttccgggcggaggcccgattgacggaccttcagcaggtatcgcgatggccgcggggattttttccgcgattcaccgcatcccgatcgaccatacggtggcgatgacgggagaaatcagcctgacggggcttgtcaaaccgatcggcggcgtcattccgaaaattaaagccgcaaaacaggccggagcaaaaacggtcattatcccttatgaaaatcagcagtccattctgaaacgaatagacggaatcaccattaaagcggtaaaaacgttccaggaagtgcttgacgtcatattggttgaccctccttcagaacaaaaaccgtttgatatccaaatgaataaagaatccgtataaaccccatttttataatggggtttttttatggaggacatcttttcctttttcagaacagaaagaaagggtatactacgaagagactgttttatatacagggcaggcggataagccgattaaagcccgatcccggaattgtacaacgatgaaaaagttgtattataatggttcatactaaagtcacggaggtgtcagtcacatggcagaagatacaaaacgcagcatcccgctcctccctttaagaggcttattggtatacccgacaatggttttacatttagatgtaggccgtgacaagtcggttcaggctcttgaacaggcaatgatgcatgatcatatgatttttttagccactcagcaggatatttcgatagacgaaccgggtgaagaggatattttcgccgtcggcacttatacaaaaattaaacagatgctgaagctgcccaacggtacgatcagagtgcttgtagaaggaattcagcgggcgcagatccttgaatacaccgaactcgaagattatacttcggtcgatatacagctgatgcatgaggatgattcaaaagacgtggaagacgaagcgcttatgcggacgctgctggaccattttgaccagtacataaaaatttctaaaaaaatttccgcagaaacgtatgcggctgtgactgatattgaagagcccggcagaatggcggatatcgtcgcttctcatctcccgctgaaattaaaggacaagcaggacattctagaaacggcggatattaaagaacgtctgaataaggtcattcgttccattcataatgaaaaagaagtgctggagattgagaaaaaaatcggtcagcgcgtcaaacgttcgatggaacgcactcaaaaggaatattatttgcgcgaacagatgaaagccattcagaaggagcttggcgacaaagaaggaaaaaccggcgaagttcagtcgctcacggaaaagatagaagaagcaggcatgcctgagcgtgtcaaagaaacggcgcttaaggaattaagccgttacgaaaaagtgccgtcaagctcagcggaaagctctgttatccgcaactatattgactggctcatcgcccttccgtggtcggatgaaacagaagataaacttgatattaaaaaagccggggaaatcttagataaagagcatcacggcttagagaaagtgaaagagcggattttggagtatttggccgtgaaacagctgacgaaaacgctgaaagggccgattctttgtctggccggacctccgggagtcggtaaaacatctcttgcaaaatcaatcagtaagagcatggggcgcacttttgtgagaatttcactgggcggagtgcgcgatgagtctgaaatccgcgggcaccggcgcacatacgtcggggcgatgccgggccgtattatacaggggatgaaaaaagccggcaaacaaaatccggtctttctcctcgacgagatcgacaaaatgtcgtctgatttcagaggcgatccgtcttcggcgatgcttgaggtgctggatccggaacaaaacagcacattcagcgaccactatattgaagagacgttcgatttatcgaaagtactgtttatcgcgactgcgaataaccttgcttccatccctggccctctcagagacagaatggagattatcagcctgtcaggctacactgaaaacgaaaagctggagatcgtgaaagatcacctgctgccgaaacaaatcaaagagcacgggctcacaaagagcaacctgcagattcgggatcaggcgattacggacatcatccgctactacacgagggaagccggcgtgagaacgcttgaacgccagattgccgccatttgccgaaaggctgcgaaagccattgtgtctgaggagagaaaacgcattaccgttacagagaaaaatctggccgactatctcggaaaacggatattcagatacggacaggcggaaaccgaagatcaaatcggggttgtcacggggctcgcgtatacgacggtcggcggagatacgctgtcaatcgaagtgtcattgtcaccgggaaaaggaaagctggttctgacagggaagcttggagatgtcatgcgggaatcagcgcaggccgctttcagttatgtccgttcgaaagcggaacagttcggaatcgacccgaaattccatgagaagtatgacattcatatccatgtccctgaaggagcggtgccgaaagacggcccttctgccggaattacgatggccacggcgctcgtttcagcattaacggaccgtgcggtaaaacgcgaagtcggtatgacgggagaaatcacgctgcgggggcgcgtgcttccgatcggcggactgaaagaaaaggcgctcggcgcgcacagagcgggcctgaccactattattgcgcctaaagataacgaaaaagatatagaggatattccagaaagcgtcagagaaggactgaagtttatattcgtttctcacctggatgacgttttggaacatgccttagtaggagagaagaaatgaaagtcacaaagtcagaaatcgtgatcagcgcggtcaaacccgaacagtaccctgatggggggcttccggaaatcgcgctggcgggcagatcaaatgtaggaaagtcatcttttatcaattcattaatcaatcggaaaaacttggccagaacgtcatcaaaaccggggaaaacacagactttaaacttttacatcatcaatgatgaattgcattttgtcgacgttcccgggtacggatttgcgaaagtttccaaaagcgagcgggaagcatgggggagaatgattgaaacctatatgacgacccgcgaagagctgaaagcctgcgtgcagattgtcgacctcagacacgcgccgtctgctgaagacgtgaacatgtatgaattcctgaagtattacggcattcccgtcatcgtcattgcgacaaaagcggataagattccaaaaggaaaatgggacaagcacttaaaggttgtcaaacagacgcttgatatggatcctgaagatgagctgattttattttcctctgaaacgaaaaaaggcaaagatgaagcatggggagccattaaaaaaatgatcagccggtaatgaaaaacccaaaacgcagtgcgttttgggttttatcgtatagttttgttccgcttgataaacaataataaaaggctgattccgatgaaaacatacggccagtatgttttgaagtgttccgtcggaatatggacggactccagccacgccgtaatttgtttaaagaagtataaaaagagggaaaaaccaatcatggcagccgcttcgtatacatattcttttctggcagccgcaaataaggagaatccgaagacgaagagaatcatttcaaaatctcccggccaccatgagagctcaggtttggcgaaaaagtgtaaacctatgccgaaaagaagcatgccgatcaggacgtgaggcccggccgcttcctttttgccctgatacaagagcacagcccccaagagcataaggagcaccggccattccccctgattcgcaaacaggtgaacctgtccgctctgaagccatgcaaataatgaagcggcaagcagaagtcccggtaataaaattgatgtttttttcatcctgtcacctacccgcagtaaaggatttttagtatgatgattacagtgggaacgagctttttatactatagcataacatttttgaaatctgttcacattttcccgaagaaactatgttataattattataaataataaattctatgttagaatgattataaataaattgcgatgtacgggggtgcatgaaagcgatgcatattcttgttgtgggagtagattataaatccgcccctattgaaatacgcgaaaaaataagttttcagccggatgagcttgcagaagcgatgctccgcttaaaagaagaaaaaagcgttctagaaaacattatcgtgtcaacctgcaaccgcaccgaaatatatgcggtggtcgaccagcttcataccggccgttattatataaagacatttttatccgaatggttctcgctgccgaaagaagagctgtctccgtttctgaaattttatgagagcgacgcggcgatcgagcatttattccgtgtggcgtgcggtttagattccatggtcatcggagagacgcaaatactcggccaggtacgctcgagctttaaaacggcgcaggcagaaaagacgatcggcaccattttcaatgagctgtttaaacaggcggtgaccgtcggcaaacgcacgcatgccgaaaccgatatcggctccaatgccgtttccgtcagttacgccgccgttgaactcgcgaaaaaaatcttcggctcattgtcaaataagcacattttgattctcggtgcgggaaaaatgggcgagctcgccgcagaaaacctgcacggtcagggtatcggcaaagtaacggtcatcaacagaacgtttttgaaggcaaaagcgcttgctgaccgtttctccggagaagcgcgcagcttaaaccagcttgaatatgcacttgctgaagctgatattttaatcagttcgacaggcgcgagtgatttcgtcgtgtctaaagaaatgatggagagagcgggcagacagcggaaaggccgtccgttatttatggtggatatcgctgtgccgagagacctcgatccggcgcttaacgatcttgaaggtgtttttctgtacgatattgatgaccttgaaggaatcgttgaagccaacttacaagaacgccgcgaaaccgctgaaaaagtcgagctgtttattgaagcggcaattgttgagtttaagcagtggcttaatacgctcggcgtcgtgccggtcatttcggcgctgcgtgaaaaggcgctgtccatccagtccgatacgatgcagagcattgagcgcaagctgcctcatctgacggtgagagagaaaaaacttctcagcaaacatacgaaaagcatcattaaccaaatgctgcgcgacccgattctgaaagcgaaagagcttgcggctgaagcggattcagatgaaaagctgaagctgtttatgcagattttcgatattgaggaagaggccggccgccagctggacaaaagcctggataaccgccagacggttcattcgtttcaaaaggcagaagcaaaaacgggcttacgtccgcttgtaagtgagtgagggctgtatgattgatacagcaatggcaagacttaatgaagcgacaattgttatttatgcagtaagcgtccttttttactttatagattttcttcaacacaaccggaaggctggaaaaatagccttctggttgctttctattgtctggactctgcaaactgtctatctttcttatttcatgtggcagacgggcagatttccggtcttgaatattacagaggccctttacttttatgcgtgggtgcttgtcacgctttcacttgtggtcacgcagattctgcgggttgattttatcgtgtttttcacgaatgtcatcggtttctcgatgattgcgatccatacgttttcaccgacggatcagcattcggccgccttttccggccagctggtctcagagcttttggtcattcatattacaatggcgattctgtcttacggcgctttttccctttcttttgtcttttcgcttctttatcagtttcaatattctttattaaagaagaaaaaatggggaaaatggctgttgagaattgaagatttgtcaaaacttgattatatggcttacgttttaaatgtcatcggggttccgatgctgctgttgagcctgatattaggcgtgatctgggcgtatgtgtcgctggaaacgctgtactggtttgactcaaaagtgctcggctcgtttattgtgctgcttttatacagctactatttatatatcagaatgattaaggaactgcaggggaaagtggcggcgttatggaattcagcatgttttctcgtgctgatgattaattacttcctgctcggaagcctgtcacaattccattggttcagttaacgcacgcgcccaaacagattcgggaggaaagaaaatgagaacgattaaggtaggttccagacggagcaaactggctatgacccagacaaaatgggtgattaacaaactgaaggaattgaatccttcctatgactttgaaatccgggagattgtcacaaaaggcgaccgcatcctcgatgttacactgtcaaaagtgggcggcaaaggtttgtttgtcaaagagattgaacaggcgctgctgcatcaggagattgatatggcggttcacagcatgaaagacatgcccgccgttttgcctgagggtcttgtcataggctgcataccgaaacgtgaggatccgcgtgatgcgctcatttcaaaagggcatcaaaagctggacggcataaaagaagggggcatcatcggcaccagcagtttaagaagaagcgcccagattcttgctgaacgccctgaccttacaattaagtggatcagaggcaatatcgatacgagacttcaaaagcttgaaacggaagattacgatgctattattttagcggctgcggggctttcgagaatgggctggaaagatgatgtcgtatcggaattcctcgaaccggaccgctgtctgcctgcggtcggccaaggcgctcttgccattgaatgcagagagtcggatgaagagcttttgaagctgtttgcgcaatttaccgatgagtatacgcagcgcacggtggcagccgaacgggctttcttacacgcgatggaaggcggctgccaagtgccgatagccgggtatgcgtccgtcaatgaccgggatgaggttgaattggtcggtcttgtcgcgtctccggacggaaagacgatttataaagaaacagcggcgggacatgatccggaagaaatcgggaaacgctgtgcggcgatgatgtctgaaaaaggagccaaagcactaatcgacagcgtgaaacaggagctcgaacaggatggcaaatgaccttcctttacaaggaaagaccgtgctcgtcacccggaacaaaagacaggcagcaccgtttcgaaaaaaagtggaggcgctcggcggaacggctgtttccgcctctctgatcgcttttcaggaagcgctcccggatgaatgtgcggacagtctgcgggaagacctttctgaaccgggctggcttgtgtttacaagcgtaaacggtgtccggttctttttttcctaccttgatcagcatggccttgcgcttccggaacggaaaaaaatcgcagccgtcggtgaaaagacagcgcgcgccctgaaagagcggggagcccggacggatgcgatgcctgacgagtatgtggcggaatgtctggctgatactttaaaacggcacgcatcagctgccgaacccgtttcattgataaagggcaatttatcacgcgatgtcataaaagcggagcttgagccgcttggctatcaaataagggaatgggtgttatacaataccattcaggatgaaaaaggcatggacgagctgagacgggctgcatcccgctctcattttgattttattacgtttaccagttcatcggcggtgcatacgtttatgcacgcggtcggagacggagaaaaagcgtgggaaaacagcggtgcgagctatatcagcatcggccctttgacagagaaagcgctcttggaatacgggatctcatcccatgtgcctgacacctatacgattgaaggcatgctggacgtcatgtgcagcatgtcgggaaaggatagataatgatgaatcaaacatttaacagacaccgccgtttgcgcgcgaacgctgcgatgagagatctagtaaaagaaacacgtcttcacccttcagattttatttacccgttatttgtcgttgaaggactcgaaggaaaaaaagaagttccttccatgccgggggtttatcatgtatcactcgatttgttaaaggatgaaatggctgagctgatatcgctcggcattaagtcggtcatcgttttcggtgtgccggaagaaaaagacgcctgcggaacccaggcttttcacgatcatggcattgtgcagaaagggattgctgaaattaaaaagcattatcctgaaatgatcgtcatcgctgatacatgtctctgtgaatacacggatcacggccattgcggggtcgtgaaagacggagtaatcctcaatgacgagtcgcttgagctgctggcgcagacagccgtcagccaggctaaagccggcgctgacatcatcgctccttcaaatatgatggacggttttgtcacagtgatcagggaagcgctcgacaaagaaggattcacgaatattccgatcatgtcttatgccgtgaaatattcaagtgaattctacggcccgttccgcgacgcggctgacagcacgccgcagttcggtgaccgaaaaacataccagatggatccggccaaccgcctggaagcgctacgtgaggctgaatcagacgcggcagaaggcgctgactttttaatcgtcaaaccgtctatgtcatacttagatattatgcgtgatgtgaaaaaccgccatcacctgccgctggtcgcatataatgtgagcggggagtattccatggtgaaagcggcagcccaaaacggctggattaaagaaaaagaaatggtgctggaaattttaacgggcatgaaacgtgcaggagccgatctgattatgacgtatcatgcaaaagacgcagcgaaatggcttgctgagtaacgatttcatttgacgggagctgaggcagatgagaagctatgaaaaatcaaaagccgcttttaaagaagcgcagaaactgatgccgggcggagtgaacagcccggtgcgcgcgtttaaatcagttgatatggacccgatctttatgcagcgcggcaaaggatcgaaaatttttgatattgacggcaatgaatatatcgactatgtgctgagctgggggccgctcattttgggccacacgaacgacagggtcgttgaaagcctgaaaaaagtagccgagaacgggacaagtttcggggcatctactgaagtggaaaacgaactggccaaattggtcattgaccgtgtaccgtctgttgaaatcgtgcggatggtcagctccggcacagaggcgacaatgagcgccctgcgtctggcaagaggatacaccggccgcaacaaaattttgaaatttgaaggctgttaccacggccatggtgattcgctgctgatcaaagcgggatccggagtggcgacactcggcctgccggacagcccgggcgtgccggaaggaatagcaatgaatacgattaccgttccatacaacgacttggaaagcgttgcactcgcattccgggagtacggtgaagatattgccggggtcattgttgaaccggtagcaggcaatatgggcgttgttccgccgcaggaaggctttttacaaggacttcgcgacattacggaacagtatggcgcgctgctcatttttgatgaggtcatgaccggttttcgcgtggattataactgcgcgcaagggtatttcggcgtgacgcctgacttaacgtgtctcggcaaagtcatcggcggcggtcttcctgtcggtgcgtatggcggaaaagctgacattatggaacgaatcgcgccgagcggtccgatctaccaggcgggaacattgtctggaaatccgcttgccatgacagcgggacttgagacgttacagcagctcacacctgaatcttaccaagaatttgtgaaaaaaggcgatatgcttgaagaaggcatttcaaaagcagctgcagcacacggcattccgcacacgtttaaccgggcggggtcaatgatcggcttctttttcaccaatgagcctgtcattaactatgaagcagccaaatcttctgatttaaagctgttcgccaagtattataaagggatggccgacgcaggcgtatttctgccgccgtctcaatttgaaggattgtttctctccactgcgcatacaatggaggatattgaaaataccattcaagccgctgagaaagtgttccaggcgatcagccgctgataccgaaaagccgatgcaagcaagacttgtatcggcttttttcaatgcctccattatcatattttcccggattgcggcatacacctttagtgacatctaattgtatggattagatgaaaggaggatatgaacttgccgcataatcaccgattgcaattttctgttgaagaatcaatctgtttccaaaaaggacaggaagtttctgaattactttcgatttcattagaccctgacatcagggtgcaggaagtaaatgattatgtctcaattaaaggatcattagaacttactggcgagtacaacatagatcacagcagtcattttgaagagcttgatagggagctgaggcatgtagaggaagtgagggcgagggaggatggcacggccgagctcattcattgtttcccggtggacatcacgattccgaaaaataaagtgagccacctcaatgatgttttcgtatttattgatgcctttgattatcagctgacggattcaaggatcttaaccattcaagctgatttggcaattgaagggctgcttgaggaatccgagccgaaagagccggagatccctttgtacgtggcgcctgaattttccagagaagaaatgatcaatcttgccggacatcattctgaggacgaaaatgaaccagaattaatgatacgccatgagcctgaaatacctttgactgtatcagaagaagcagcacaagaaacagagaagaacgaggaagaaatcccgcctttactcaggcaggaggaagaagagcaggaaacagccccgattctgagggagcgggaagaagaaaagcaggaaacagccccgattctgagggagcaggaagaagagcaggaaacagccccgattctgagagagcaggaagaagagcaggaagcagccccgcttctgagggagcaggaagaagagcaggaagcagccccgcttctgagagagcaggaagaagagcaggaagcagctccgattctgagggagcgggaagaagaagagcaggaagcaggcccgattctgagggagcgggaagaagaaaagcaggaaacagccccgattctgagggagcaggaagaagcgcaggaagcagctccgattttgagggagcgggaagaagaagagcaggaagcagccccggttttgagggagcaagaagaagaagagcaggaagcagccccgattctgagggagcaagaagaggtgcctaaacctgtttcctttactgagcctcctcctcccgtttccttccagcacgaagaagagccggaagaagctgaggagcctgcaatcatgtcagctgtgaggaatgaacccgtatttgaggatgattcagcagaagtgcaggaagagccgaaagatgatatcgaaccggttttccctgctttcactctgactccgcatgcagaaaaaccaaaaattgcggaacagcccttccttcaaaaagaagagcagccagaggccgagccgcttctccgtcagagcgatcataaggcggcagaagacgaagatgagcctgcggtttttcaagaggagcaggcgcccgtttatcgcgagttcgttccggaacggcaggaagaggagttttacagcgctcctaagctgcttgaagaagaggctcatggtgaagaagggtttgaaattgaggtaaggaagatggcgccgccggaggaggaaaccgggaagcctctcgatttgtcttttcagttttccaaactgccgcctgaggagccggcgcaagctgaacagcctgagccgcttaagcctgaaagaaagaatgaagaagcggcaccgggaaccgagcagaaggaaaatgacaactctcattacttgacaaaattatttacaagggaagaagaaaagttttcaagaatgaaaatttgtatcgtgcagcagcaagatacaatcgaccgggtgtgtgaacgatatgacattacatcccagcagctcatccgaacgaatgctttatcgtttgatgacgagcttgaggaaggtcagcttctgtatatacctgaatataataacagccatgtgtaagcacaaagaggccgtaaaaatgtggtgaatggaatggaagcagtccaatcagtgcttcaggaatacgggctggcggctgagtatattgagcctgtcagcccgcatgtttggaaggtctactcaaactacggcatttttgctttgaaacagctcaagccggcccgcagcagtgaatttacggatcttatgattgagattgaggagaaaggctaccgatcatttgtgccgatctgccgcacgtatgccggcgatttttttgcggggagacagacggagaattcttattatttaatgccttggcttcagtacgatcaggaggaagaacgggatcaaaaacatgtttacctttttaaagaggtcgcgaagctccattctgcgactgtgcgggacatccaaatccggactgaagatatcagcggcttttatgaagcaacgaaaagagattgggaaaatgataagcttgtctatgaacaattcgccgaccgggcggaaaaagagtggtacctttcaccttttgaactgcaggccgttacgtatcttacagaaacggtttccgccgtcaattttgctctggaacgtctggaagaatggtttgacgcggcaaaggatcatgacaagacgagagcggtgatcaaccacggcagtttatcgagccgccactttctgtataatgatgcgggatcgggctttttcacgaatttcgagaaagctgcgctgggccctccgcaaaatgacctgctcggcttttactccagaatgttcagaagctatccgaaagcatgtccggaatgtctggactggttttatacgtatcacaaatcattcccgctccgtgaagcggaaatcagtctgtttctcagctatatggcttatccgtccgccatgtacaaagtgctgaaacggtatcagaccggccaaaggggctctgaaaaagaagagtgcacgcaattattaagagcgttttggcagatgaaaaatgttgagccttttctcatgaaggttcatcagattgagcgggagaaaaaaataaaagcggaaaacgagtcctcttcataacaggactcgtttttttatatccattccaaatgcagggcgcacgctaaaaacagcaggatggcaagcagcaggacatcaaaagtcgtcggaaagaaaatcgtcctgatcccctgaaagatcgtaatcggaataatgacttgcacggatacaaggcggacctgtctggcccactgggggagcgaataagaattgaatttttttctcacgggcaattcctcctcacattcgcctttctatgtatcgtatgtaaggggaagagcggggtgcatgcccatttatgtatgacggcagcggtttttggaaaagatgattgacgaatcaaaaacacttttactataataaagaacataataaataagatcatgagctgatataaatacacctgctttgaacgggaagagtacaagaaagacgcatgaagagagagaagctactgtgctgaaaggcttcttatgccgtctcattggaaggtcgcccgggagcataatttcttgaacatacagtagagaaattcgggccgcacccgttatccgtttaagtgcatgaacaaatctgttcatgaaaaaaggtggtaccgcgaaagagcttttcgtcctttatcaggatgaaggctcttttttagttgctcagccatttctaaacatgctggagggttatcatggatacaaacgaacaaacaatgccgacaaaatatgatccgtctgcgattgaaaaaggccgctatgatttttggctgaaaggaaaatattttgaagcgggcggcgatcaaacgaaacagccgtattctgtcgtcattccgccgccgaacgtgacgggcaggctgcacctcggacatgcgtgggatacgacgctgcaagatatcgttacgcgtatgaaacgcatgcagggctatgacgtgctctggcttccgggcatggaccacgccggcatcgccactcaggcaaaagtcgaagcgaaactccgcgaacagggcacaagccgttatgacctcggccgtgaaaagtttttagaagaaacgtggaagtggaaagaagagtatgctgatttcatccgcagccaatgggccaagatgggactcggactcgattattcacgtgaacgtttcactcttgatgaagggctgaacaaagccgtgcgtgaagtattcgtcaagttgtacgagaaaggcttgatttacagaggcgaatatatcatcaactgggaccctgccacaaaaacggctttatccgatattgaagtgatttacaaagacgtacagggcgcgttttatcatttgcgctacccgttagcagacggttcaggctcaattgaaatcgcgaccacccgtccggaaacgatgcttggcgacacggctgtcgcggttcatcctgaagatgagcgctacaagcacttaatcggcaaaacggtgattctgccgattacaaaccgtgaaattccgattgtcggcgatgattatgttgatatggaattcggatcaggcgccgttaaaatcacgcctgcccatgacccgaatgactttgaactcggaaaccgccacaatttagagcggattctcgtcatgaatgaagacggaacaatgaatgaaaaagcgctgcaatataacggcatggaccggtttgaatgccgtaaaaaactcgtcaaagatcttcaggaatccggcgttctctttaaaatcgaagaccatatgcattctgtcggccacagtgagagaagcggcgccgttgttgagccgtacctgtccacacaatggtttgtcaaaatgcagccgctggccgatgctgcggttgaccttcaggcaaaagaagagaaggttcacttcgttcctgaccgtttcgagaaaacgtacctgcactggatggaaaacatccgtgattggtgtatttcccgtcagctgtggtggggccaccgcatcccggcttggtatcataaagaaacaaaagaagtgtacgtcggccttgaggcgcctgaggacagcgaaaattgggagcaggattcagacgtgcttgatacatggttcagctccgcgctttggccgttttctacaatgggctggcctgatgaaaacgctgaagactttaagcggtattactcaaccgatgtacttgtaacgggatatgacatcattttcttctgggtatcccggatgattttccaaggtcttgagtttaccggcgagcgtccgttcaaagacgtgctgattcacggcttaatccgtgacgagcagggcagaaaaatgagtaaatcccttgggaacggcgtggacccgatggatgtcatcgacaagtacggagcggattccctgcgctacttcctggcaaccggaagttcaccgggacaggatctccgtttcagctatgaaaaagtggaatccacatggaacttcgcaaataaaatttggaacgcctcccgttttgcattaatgaacatggacggcatgacgtatgacgagcttgatctgtccggtgaaaaatcagttgctgataagtggatcctcacaagactgaatgaaacgatagaagacgtgacacagcttgcggatcgttatgaattcggtgaagtcggacgccacctgtacaactttatctgggacgatgtgtgcgactggtatatcgaaatggcgaagcttccgctgtacggggaagatgaagcggcgaagaaaacaacccggtctgttctggcatacgtgcttgaccagacgatgcgtcttcttcacccgtttatgccattcttaacggaagaaatctggcagcaccttcctcatgaaggcgagtcaatcacgatcagctcttggccggttccggtgccggaacatacggataaagaggcagcggcggatatgaaactgctcgttgaattaatccgttctgtccgcaatatccggagcgaagtcaacacgccgatgagcaagcaggttgaactttacattaaaacatctaccgaagacattgccggccgccttgagaagaaccgttcttacgttgaacgctttacgaatccgagcacgctgaaaatcgggacggatatcgctgcggcagacaaagcgatgacagctgtcgtcaccggagcggaagtcattctgccgcttgaagggctgattaacattgatgaggagatcgcccgtctgcaaaaagaattcgacaagctgacaaaagaagtcgaacgcgttcagaaaaaactcggcaacgaaggattcattaaaaaagctcctgagcatgtcattgaagaagaacgcggaaaagagaaagactacacggcaaaacgcgaagctgtccggcagcggattgcagagctgaaaggctgataaaacagcggggcggtttcctaagaaaccgccttgtcgtataaaagaggggatttcattgtttaatacgtacaaagaagcgatcagctggattcacggcagactcaagttcggcgttaagccgggccttctccgtatggaaaagctgatggaaaaactggaacacccggaaaagaacattcgcgccattcatgtggcgggcacaaacggcaaaggatcaaccgtttcttttatccgttccgtccttcaagaagccggttatacggtcggcacgttcacatcgccttacatgattacgtttaatgagcgaatcagcgtcaacggcacgccgattaccgatgaggaatggagaacgctcgttaatgacataaaaccgatagtcgatgagcttgataagaccgatgccggaacggtgacggaatttgaaatcattacagcgtgtgcatttttatattttgcgaagcgggctgatatcgattttgtcatttttgaagcggggctcggcggcacatttgattcaaccaatattgtgaaaccgcttctgtcggtcattacaagtatcggacatgaccatatggccattttaggcaataccatcgaggagatcgccgggcagaaagccggtattattaaaaattccattccggtcattacgggcgtcaatcagccggaagcactcggcgttattgaagcggaagccgaaaaaaagcaggctccgtatcagtcactatataaaacgtgcagactgtttaatgaagcggcgcttccgtccggcgaaagcttttcgctggaaacagaaacgaaatgctatgaaaacattcaaacgtcgctgatcggcattcaccaaaggcagaatgcggcattggcgatattggccgctgaatggctgaatcgcctggaggccgcagtcatttcagaagaagcgatgcgaaacggactgggaaaatcttcctggccgggccggtttgaacgtcttcaaagccgccctttagtgtttgcggacggcgcccataacgaagagggtgttgaaacgctgacagaaacgatccggcagcgctttgccggtaaaaacgtccatgtcgtattcagcgcattaaaagacaaaccgtatcaggaaatgattaaaaagcttgaaaccgaagcggattccattcactttgtatcatttgactttccgcgtgcttcaagcgccgaagccctttacaatgcaagcagtcttgcatctaagagcttcgatgagaacccggacagtgtgaaagaatggatagaacaaaaagacggggcggatgatgtcatcatcattaccggctccttatattttatttcagagatgagaaagcggcttatctgacagcctctcggatgcccggcagaccattttccggttttgccgggtgtttttatgctgaaaatatattttcagccatttcagtcatggtgtttttctttgctataatctgagccagattgatagtaaaggtgtggtctgagtgcttttaattctgttttttctcggcttgattttcggttcttttttttatacagcagcgtgccgtatcccgctgcgaatctcggttatttcgccgcgttcatcctgttcgttttgccgcttgccgctctcctggggggagcttgtgcccgtcgtctcctatattctgcaaagaggcagatgcagaaactgccgtgcgaagctgtcggttatgtatccggcggcggaatgctggacggcgtgtttattcacggctgcaggcattcatttcggtttctcaaaagaactgttagtcgcgctgttatttctgtctctcctcatgattgttactatgacggatctgcaatatatgctgattcctgacaaagttctgctgttttttcttccgcttttcatcgccggccgaatgttttctccgctggattcatggtatgcagggtttgccggagccgtttgcggattttttctgcttgtttttatcatgtttgtcagtaaaggaggcatcggcgcaggtgatgtgaaactgtttggggtgatcggcctgacgctcggcgtgaagctcgtgctcattgcattctttctttccgttatgatcggagcggtatacggtatgtgcgctgcagcccggggcagtcttggtaaaaagcagccatttccgtttgcgccggccatctcagccgggagcgctttgagttatttatacggtgatgagctgttttcgttttacatcaagctcgcttcaggcggggcttgaaaaatttggcgaacgttttttggacaagacgacaaaagtcttgttcttttttttttcgcctatgctaaagtgtgaaccatgatcagttcaaggtacggccaagacgaatgcaagggggaagagacgttgaaaaaaaggaagagcaaaaagcacagcaaagctaaaaacaatgcccttaaagtaaccattaacggacaagaagaaacgatgtatggacaagaagatgtgaatgaaggcggggagaagaccgtcacattttccaattgggaagaaacaaaaaaggcggaacaggagaccgccgcttcccatgaagatccgaaagaagaagatttcaattgggatcatgagaagaattctgaggtatttgaagatgacccgaaagtcgttccgccataccagaagaaaaaaacaggccctcattttccgaaaaaaaagcagccgtcttctccagttaaaaaagcggtcacgacaattgccgttgcggctgttttaggcaccgggctcggccttgtcgccttaaatatgtcgggaagtaaagaagcctccgctccggcatcagctgacaaaggttcacaagggcagacggtgaaagcgggagatgtttctaacgacaaatctgaaacagccggcacaggagatgcggaatcttcagcgggaaactataaaacatatgcggtgcaggccggaaaattttcatcagaaaaaggagcgcaaacgcttgttgaccagctgactgaaaaaggatactcggccgtctctctggcaaaagaagacggatacacatacgtgatcgccgggcttgcagcggaaaaaagcttatcacagcaattgggtcagacactgatagaccatgattttgaggcttggggcggaaaagagctcagctttgcggtcgattcagggctggaagactcttttaaacaggcatctgagctctccgccaaagcgattaccggcaaaaatctttcaaaaacggaagtggctgaagcggcaaaagcggcagacggcgcagacgccgctgacaaaaagcagaaagaggccgtgcttcaagcgctgaaagaactggaaacgtcgggttcggaatccggctggaaagcccaaaaagagctattaagtgttgtaaaatagtatctcatttcccgtcatccggcgggattttttattttgtcatcaaaaagttatttttctgaaattgtggttgcccgtttgatttggtaggatagacaagtatctttttttcttaagcaaaccctgaaaggatgacaaccatgacaaaacgcttaatactcgcatcacaatctccgcgaagaaaagaactccttaatcttcttcagattccttacagcattattgcgagccgcacagaagaaaaattaaatcgaaacctttcgccggaagaaaacgtccaatgtttggccgagcaaaaagctagtgctgtattggccgaaaatcccgatgcagtcgttatcggggctgacacgatggtgtgcatagacggcgagtgcctcggcaaaccgcgtgacagggaagaagcggcacagatgctgcggaggctttccggccgaagccatcaagtcattacggcggtcagcattcagacgcgtgaccggaaagaaacattctgtgacacaacggaagtgacgttttggccgctcagtgaagacgacatacagctctacattgaaacaaaagaaccgatggataaagcaggtgcatacggcatccaaggaaaaggcgcgcttttagtgaaaaaaatagacggtgatttttattctgtcgtcgggcttcctgtcgctaaaacaatgagagccttgaaagaatttaatataaaagcttgatgttcaaaccgggaaggggaacaaggaggggttgatcatccgtgatctgccgttaaaattaagagatttccccgaaaaagaaaaaccgagagagcggcttctgcacttcggagccgaacatctctctaacaatgaattgctcgccatcctgctgcggacgggaacgaaacatgagtccgtcatgaacctcgctcaccggctgctgcggacgtttgacgggctgcgcctgttaaaaggcgcctctgcccaggagctttccagcattccgggaatcggaacggtgaaggccgttcagattcttgccgcaattgagctggggagccgcattcataagacatccgccggggagcattgcgtcatccgctctccggaagacggggcgaagtatgtgatggaggatatgcgctttttaacccaggagcattttgtctgtttatatttaaataccaaaaatcaagtcattcataaacgcaccgtttttatcggaagtctgaattcatctattgtccacccgcgggaggtgtttaaagaagctttcaaacgatccgccgcgtccttcatttgcgttcataatcatccttcaggagatcctacaccgagcagggaagatatagaggtaaccaggcggctttttgagtgcggaaatttaatcggcatcgagctgctggatcatttggtcattggtgataaaaaatttgtgagtttaaaggaaaaaggatatttgtaacactttttttttcgttgatttaagatataatagattttatgagtttttccctttagggtatttttgctttaagaaaggaagatacatacatatgttcggaattggtacaagagaccttggtatagatttgggaaccgcgaatacgcttgtgtttgttaaaggtaaaggaatcgtagtgagagagccgtctgtcgttgctctgcaaacggatacgaagtcaatcgttgcggtcggtaacgatgcgaaaaacatgatcggaagaactccgggcaacgtggttgcgctccgtccgatgaaagacggcgttatcgctgactatgaaacaactgcgacaatgatgaaatactacattaatcaggctgtgaaaaataaaggattgtttgcgagaaagccgtacgttatggtgtgtgtgccgtcaggtattacggccgttgaagaacgggcggtcatcgacgcgacaagacaagcgggcgcacgtgacgcttatccgattgaagaaccgtttgcggcagcaatcggtgcgaatcttccggtatgggagccgacgggcagcatggtcgttgatatcggcggcggaacaactgaagtggcgatcatttctttaggcggcattgtcacgtctcagtcaatccgcgtagccggtgacgaaatggacgactcaatcatcagctatatcagaaaaacatataatctgatgatcggtgaccgtacggcggaagccattaaaatggaaatcggttcagcagaaaccggtgaagaaaatgcgtcaatggaaatccgaggccgcgatcttctgacaggtctgccgaaaacgatcgaaatcacgggaacggaaattgcaaatgcactgcgtgatacagttctctcaatcgttgatgcggtgaagagcacgcttgaaaaaacaccgcctgagctggccgctgacattatggacagaggtattgtattaacagggggaggcgccctgctccgcaatctcgacaaagtcatcagcgacgaaacgaaaatgcctgttcttatcgctgaagatccgctggattgtgttgcgatcggcactggaaaagcactggagcacatccatcttttcaaaggaaaaacaagataatcaggagttaaatagaagaggtgtatcacgatgccgaacaaacggttaatgctattacttctgtgtattatcatattggtggctatgattggattctcgctgaagaacggccgtaataccacctggcctgaaaagctgatcggtgatacgacgggagtatttcaaaacatttttcacacgcctgccgaatattttgcagggttcttcggggacataaaagacctgaaaaacacgtacaaagaaaacgaacgcttaagacaaaagctggacggacagacacaatatgaagcgaagctccaagaactcaaagatgaaaacaagaagctgcgtgatgaactcgggcatgtcaaatcaatttccgactatgatccgattttagcgaccgttatcgccagaaaccctgatcaatggtacaagcagatcatgatcaataagggaacgaagcacaaagtggccaaagacatggctgtcacgaacgaaaagggtgcgctggtcgggaagatcaaaagcagcggactcaacagtttcacatccgccgttcagctgctgagcgatgttgaccgcaataacagagtggccaccaaaatctccggcaaaaagggaagcaaaggctacggtttaattgaagggtatgataaaaagaaacagaccctgaaaatgaccatccttgaaccggatgaaaaacgtgaagtgaaaaaaggcgacctcgtggagacctccggaacgggcggcgtatttcctcaagggctgacggtcggcgaagtgaccgatgtagaatcagatgcttacggcctgacgaaaatcgcttatgtgaaaccggctgccgacttgtacgatcttgaccatgtcatcgtcgtgaaccgaagcgtagcaacaggggaggaaggatcgtgaaacgtttccttctccctttgattatgattttggtcttttgtgcggaaagcatctataccgatctggtgcgttttcctttcgtttccgtcgagcagcaggtcgttccgcattttcttttgcttgcgctgatttttatgtcggcttatatcaaccaaaagcatgcggtgatctacggtttcattttcggatttctttatgacatcaattatacgggtgttttaggcgtttatatgtttggttttgccggattatgctatctggcggccaaagcgtttaaagtgctgcagacaaacgccctgatggtcattctggtcgcggtgctgagcgtatgtgtgcttgaattttacgtctacggcattcagacgttaatccgcagcggcactatgacgtttaacgattttgtcattcagcgattcttgccgaccgctttgctgaatatcgcgggagccgttatattagtcctgcccttcaggctgttttatataagtctgaagaaagaattaagagatgagtaaaaaggattttatctttttttgacgaaaagagtatgttgttgaggtgaacattgatgaagaccaaaaagcagcaatatgtaacaataaaaggaacaaaaaacggcttaacattgcatctggatgatgcgtgttcttttgatgagctcctcgatggtcttcaaaacatgctgtcgattgaacaatatactgatggcaaaggccaaaaaatcagtgttcatattaaactcgggcatcggtatctgtatcaggaacaggcagagcagctgactgatctgatcgcgtcaaagaaagatttagtcgtgcattcaattgacagtgaagtcatcgccaaagaagaagcgcagcggatgaaagaggagcaggaaattgtttcggtttccaaaatcgtccgttcgggccaggtgcttcacgtgacgggagatttgcttttaatcggagatgtgaatcccggcggtacgatcagagccggaggaaatatatttgttctcggttcattaaaagggattgcccacgcgggttataacggaaataaccgggctgtgatcgccgcatccgaaatgatgccgacacaattgaggatcaatcacgtgttaaatcgctccccagaccacattcaaaaagggaacgacatggaatgtgcttatttagatactgacggaaatatggtcattgaacgccttcagcaattggctcatttaagacctgatctaacaaggcttgagggaggaatgtgaaattgggtgaggctatcgtaataacttcgggaaaaggcggagtaggtaaaacaacaacatctgcaaacctcggtaccgccttagccattttagggaagcgcgtctgtttggtagacacagatatcggactgcgcaaccttgatgtcgtaatgggtcttgaaaacagaattatttacgacttagtagatgtaattgaaggccgatgcaagacgcatcaggcgcttgtcaaagacaaacgttttgatgatctgcttcatttaatgccggctgcccagacaagcgacaagacggctgttgtccctgagcagatcaaatcgcttgtgcaggagcttaagcaggaatttgattatgtcattattgattgtccggcgggaattgaacaaggctataaaaatgccgtctccggagctgataaggcgattgttgtgacgacgccggaaatatcagcggtgcgggacgctgaccgcattatcggacttttggagcaggaagatatcgaaccgccgcgccttatcgtgaaccgtatcagaaatcacctggtgaaaaacggtgacacgatggatgtggatgaggttgttcatcatctgtctattgatctcctcggaatcgttgctgacgatgatgaagtgatcagggcttcaaatatcggcgaaccgattgccatgaattccaaaaaccgcgccagcattgcgtaccgcaatatcgcccggcgcattttaggagaatccgttcctttgcaggtgcttgaagagcagcaaaaagggatgatggcgaaaatcaagtcatttttcggcgtgcgttcataatatataccagaatacaaagatctgatgaagcccagcttatcaggtcttttttgttttttaagagcgcatatttgcaatggacaagacataggatgtacaaacccaacgattgcaaaggatgatggcgatgagtcacagagctgatgaaattagaaaaagactggccaaaagaagaaaacagcggcctgaatcaaaacggactttcgttcaaaacgctcaaacgcagaattttcccgcgtggcagacggtcaaggagcaggaaaagcacaagcttcttccggactacgaatatcaaacggaacacccgcccgaatttaacgggcggcatccattgatcagcgctcattctattattttaaaatgcctgctggccgcctgtctcgtactgatctccgctattgcctataaaactgacaaacagccgctgagtcagatcaaaccggcaatcgcacaaacctttcaaaaagaatttcagtttgctgccgtaagcaattggttcgtatcttccttcggaaacccgctcgcttttcttacgccgggaacgaaaaagaaggacggtcaggtggcggtcagtcaggatatggccgttcctgccgcggggaaaatccagcaggactttcaaaataacggagagggcgtcgtcgtcgaaaccgccagtgaagccattgacagcgtaaaagaaggctacattatggaagtgagcaaagataaaaaaacagggctgacggtgaaggtgcagcacgccgacaatacaagcagcatttacggccggctgaaagatgttaacgtttcattgtacgattttgtcgataaagggaaaaagatcggttcgatcaagctcaacgataaaagtaaaggccagtactatttcgcgatccaggatggcgataaattcatagatccgatccaggtgatcacatttgatgaataaatggctcatcctcctttttaaaattcatgtccatccttttctttggattatcatggggctcggtcttatgacggggcacatcaaagcgctgctgtgtcttttgctggtcgtatccgttcatgagctggggcatgctgctctggctgtgtttttttcgtggcgcattaaacgcatctttctgctccctttcggcgggacggttgaggtggaggagcacggaaaccggccgcttaaagaggaattcgcggtcattttggcgggcccgcttcagcatgtgtggcttcaggcggcagcctggctctttttcacgtcaggttttgcaagtgagcagacatttgagatgtttaccttttataacctctccattcttttcatcaatcttttgccgatctggccgcttgacggcggcaagttcgtgtttttatacttctctaaacaaatggcttttcaaaaagcgcatctcctcagcctgcagacatcggccgtttccgcgcttttgctctgctgctggattgtgctggccgtcccccttcaggtcagcgcatgggtgctgttcgtctttctcgccgcttctttatgggatgaataccggaagcggcattatattcagctgaggtttcttttggagagatactacggcaaaaaccgcgatgtcgccatgctgcatcctttgacggtcgcggccgatgccaaagtaaagcatgtcatggctgaattcaaacggggatgcaagcaccccattatcattgaaaaagccggcgaaaagctcagccagctcgatgaaaatgaagtgcttcatgcgtattttgccgataaacggacagattcctctatggaagacctgctgctgccttactagaaatagattgacatatccttttggttctgatatattttttaatgttatggatgtagcaccaatgctacaaccgctcgggacaggtgataagagctttaaagccccctgttgctggcgagtcttagtctaataggaggtgcagagaatgtacgcaatcattaaaacaggcggaaaacaaatcaaagttgaagaaggtcaaactgtttacatcgaaaaacttgctgctgaagcaggtgaaacagtgacgtttgaagacgtattgtttgttggcggagacagcgtgaaagtcggcaacccaacagttgcaggcgcgacagttacagctaaagttgaaaaacaaggccgtgcgaaaaaaatcactgttttccgttacaagccaaagaaaaatgttcataaaaaacaaggtcatcgtcagccttatactaaattgacaatcgaaaaaatcaacgcgtaagcatgattgaggcaacaattcgaagatcccggaatgacgggggcattttgtcctttgaaatgacgggacatgccgattttgctgaacatggacgagatctcgtttgcgccggggtcacggctgtcgttttcggagcggtcaatgcggttatcgcgctggctcctctcgaaccgattcttgatataggcgaggacgggggttatttctattttgaattccctgaagccgctgatcaggaagctttgcaaaaagcgcagctgctgattgaaggcatgattgtttctcttgaaacgatcgagcgggattacagtgaacacttacggttgactgcaaaccaaatataggaggtgagttacatgcttagattagatcttcagtttttcgcttctaaaaaaggtgtaggttctacaaagaacggacgtgactctgaatctaaacgtttaggcgctaaacgtgcagacggtcaattcgtaacaggcggatctatcctttaccgtcaacgcggaacgaaaatctacccaggtgaaaacgtgggccgcggaggagatgacactctttttgctaaaatcgacggaactgttaaattcgaacgtttcggccgtgaccgcaaaaaagtgagcgtatatcctgtagctcaataatgacacaaaaaactccggtcgttgactggagttttttttgcagtaagcggagtaacatcaagaatgaaaagcagaggatgcgtgagtgaaccccgccttgaatgaggacatcagcttctcatacccactggatatgttccccaagcagtgataccaaaaatgtttctgcctggcatccgcattgtatgcgatccgaaaaaggaacatgatgaaccaggaaaaacaagtgtttttttaacaaagccttctctgttataattcatagtacacacttatcaagactcctaaaaagaaattaaacgattgggagtgcgaaaatgaaggatgtatcgaagaaacaagaagaacctgtaagcgatgcggctctgatcaatgaactgatccaattaatgggccatttccgtcatgattggatgaataagctgcagctgataaaaggaaacttaagtttgcagaagtatgacagggtcgttgaaataatcgacgaaatggtcatagatgcaaagcacgagtcaaagctctcaaacctgaaaaccccgcacttggcgtttgactttctgacatttaattggaagtcccgttatatgaggctcgaatacgaagtgctcggagaaattaaagatttatcggcatatgatcaaaagctgtcgaacctgatgagaaaactgtttcatctgttcggtctggcggtaagcaatgaaagtgaaaatcatctgaccgtatcgctgcagacggatcaccctgacagacagcttattgtatatctcgattttcatggaacgattgcaaatgcagatgtgtttgatgaatttcgcaaatcccggtatgaggactttgatgtcatgcaatttgagctgaccggccatgaatgtgtggccgaaattggaatgaactagcggttttttacggtttagaacggaggatattatgtttgtagatcaggtgaaagtatatgtaaaaggcggcgacggcggtaacggaatggttgcgttccgccgtgaaaaatatgtgccgaaaggcgggcctgccggcggtgacggaggtaatggaggcgacgtcgtttttgaggttgatgaaggactgcgcacgctcatggacttccggtaccagcgccatttcaaagcgatacgcggcgagcacggcatgtctaaaaaccagcacggcagaaatgcggacgatatggttgttaaagttccgcccggcacagtcgtaacggatgacgatacaaaacaggtcattgccgatctgacagagcacgggcagcgcgccgtcatcgcaaaaggcggacgcggcggacgcggaaatacccgctttgcgaccccggccaacccggcgccgcagctgtcagaacacggagagcccggaaaagagcgctatatcgtgcttgaactgaaagtgcttgcagacgtaggtctcgtcggcttcccgagcgtcggaaaatctacgcttctgtctgtcgtttcatcagcaaagccgaaaatcgccgattatcattttacgacgcttgttccgaatctgggcatggtggaaacggatgacggaagaagcttcgtcatggcggatctgcccggtttgattgaaggagcgcacgaaggagtcggcttaggccaccaatttctccgccatatcgaacggacgcgcgtcatcgttcacgtcattgacatgtcagcgatggaaggccgtgatccgtatgaggattatgtgaccattaatcaggagctcagtgaatataatctgcggctgacggagcgtccgcaaattatcgttgcgaataaaatggacatgcccgaagcggctgaaaatctaaaagcgtttaaagaaaagcttcaggatgaccatcctgtcttcccgatcagcgcggtgacgagagaaggactccgcgatcttctgtttgaagtcgccaaccagctggaaacaacgcctgaattcccgctgtatgatgaagaagaactggcggaaaaccgtgtaatgtacacgatggaagatgaagaaattccatttgacattacccgtgatccggacggcgcgtttgtgctttcaggtgacagtctggaacgtctctttaaaatgactgacttctcccgtgacgaatccgtcaagcgttttgcaagacagatgcgcggtatgggcgttgatgaagcgctcagagaacgcggtgctaaagacggcgatatcatccggctgctggaatttgaatttgaatttattgattaaaaagacggagagcttgcaatgcaggctctctgatgtaaaagggaggggtgcaggtgaaagaagagacattttatttagtgcgtgaagacgttctgcctgatgcgatgcggaaaacccttgaagtcaaaaagctgctcgacagaaaaaaggctgaatcggttgcagatgccgtgcagaaagttgatttaagcagaagcgctttttacaaataccgagatgcggttttccctttttacacgatggttaaagaacaaataatcacacttttctttcatttggaggatcggtcaggcgcgttatcccagcttttgcaggcggtggctgactcaggaagcaacgtgctttccattcaccagacgattccgcttcagggcagggcgaatgtcacgctctcaatcagtacgtccgcaatggaagaaaacattcatacgttaatgaataaactgagaaaatttgattttatagaaaaagttgagatcttagggtcaggcgcgtaaggagagaagagacatgaaagtcggttatttagggccagaagccacatttacacatctagcagtcagttcctgctttcaaaacagcgtgacacaagcaccttatcaaacaataccggcatgcatggatgcggcggttgcgggagaagttgatcttgcatttgttcctttggaaaacgcgctggagggctcggttaacttaacgattgactacttgattcatgagcagcctcttgcgatcgtgggggaaatgacgctgccgattcaccagcatctgctcgttcacccttcgagagaaaatgagtggaaaaagcttgagaaaatttattctcattcccatgcgattgcgcaatgtcacaaatttcttcaccggcatttttcgtccgttccttatgagtatgcgaagtcaacaggtgcggctgccaagtatgtcagtgagcattcggaccttccgatcggcgtgattgcaaatgaaatggcggccgctacatacggattgagcatcgtgaagcgggatattcaggattatcaggacaaccacacgagatttgtcattctttcgcctgaaaaagacgtctcattcgaagtgaatgcgaaactgtcttcacggccgaaaacgacgatgatggtaacgcttccccaagatgaccaatcaggcgcgctgcacagggtgctgtccgctttttcatggagaaacctgaatttatcaaagatcgaatcgcgcccgaccaaaacgggtctcggcaactatttctttattattgatattgaacaggcgatggatcaggttctcattcccggtgccgttcaagagatggaagccctcggctgccgggtcaagcttctgggaacatatcaatcctattcgatataaaaaaagctccccttcagggggctttttttttaatcttttattaaaatacccgcgtcgtccagcgcttgacaggcttggtcaatccgctcttttgtcggggcgcttaacgtatggagatgcacgcctccggtcagctgtgaaaggtaagcggcatttgtcgagttaatgtgatccatgaattgtttgacttctttccgtgtgctgactcttatggcggcggttaaatcgccgtatacggggtgttcaataatgacgtcctttatggtgacgccttcatcgacaatgagttcaagctcttcttccgtccgctccgggccgtgcagacaggcgacaatccgttcggcgtttttttcgccgccggcattcatgctgatgtataaatagccttggctcgtcgcgataatcggttcgctttttgctttcaagagcgatatgtcctgcacgatcacctgtcttgaaacatttgcttttttggccaattcgcctcctgttaatggcgagccggcttctttcagccaatgaagcagcatgtcgcgtcttttcgccccagtaagcttcgttccttctgtcaaattgctgattctcctttcttttgctcccatagcgccgtaaatgtatgtatcagcatatcgagctgttcacatgttgtttcgtttccgaatgagatccggaaaaactgccgcgcttcccgttcggtttttctcagcgccttcatagctgaagaagggccgtggctgccggcggaacatgcgctcccggttgagatgcaaatatcgttacgattacattctaacataatatattgtccttcaaaggagtgaaaaaaacacccgacaatgtggggcaggcattcaccgccggtttcttcctctgaaaatgaaatggggaggccttgacgcctaatttggtcatacaaataattcctcagcctgtcagcatgctcacggtgttcctccatatgtttcactgcatactccgcagcagcggtaaaagcgccgatggccggcacattcaccgtaccgggcctgaacccgttttcatgcacggtatgcggataaaccggattccagctgacacccggccgaatgtaaacagccccggtgcctttcgggccgtatactttatgaccggagacggaaagggcgtcgattcccgcctgatccgcatcaatcggcagtttgccgaaactttgaacacaatcgcaatgcagtaaaatgtttctctggtgaagaaaagcggccagacgattcacaggctggatgaggccggtttctgaattggcgtgctgtatggaaacgagccccgtgtcaggacggatatgagccgccagtatgtcctcggttataaggccgttttcgtcgggatatatgatggtgacatcaattccccggtcagctaaaaacgccgcggcattatggatcgagtggtgttccattgcggtcgtaataaaatgttttttatgatcgggcagaccgtacagcaatgattggacggccaagatgttcgcttccgttccgccgcttgtaaagtgaatgccgtctgccgctccgccgatcaattttcctgcagaatgtctgcaatattccagcacgtccgccgctcttcctccggcgtcatgaaggctgctagcattgccgtatacctctgtgctgagatgctgaaagactttcgcggcttctttgcttaaaggcgttcccgccgcgtaatcaagataaatcatacagcccgtctcctatccgtttatgttaaaaaaagcttgagtttattttatcgttgtgtaaatataggtgtcaagacaggtgtaaatataatgggagggtgatgtatgtctgaaaaaacaattatcgtcattggtacggggacggcggcccttgcctgtgcttcctcatttcctccgtcataccaagtaaccgtcatcacaaagagaaacgtaacgaacagcaattcgtattatgctcaaggcgggattgctgtttcatacgcaaaagatgactcgatagaatcccatgtgaacgatacactgtatgcgggatgcggacacaatgacgtgacagccgtgcggcatttgctgcaaagcggacagagcatgataaacaggctgatagaaggccttttcccttttgatacgaagtcggacggaacgttttgtctcggcagggaaggcgctcattccaaaaggaggattctgcacgccgggggagatgcgaccggacggatgctggttgagtttctggttcggcagctgagggacggcattcggatcattgaacacgagacggttgttgatctgctgattgaacacgggcgatgcgcaggcgttgccgtaaaggatgcttcaggtgccgtttcttacagaagagcggattgtgtagtgcttgcttcaggcggctgcggcagtctgtaccaatatcacacaaatgattccgccataacgggagacggcatcgctcttgccttccgcgcgggagctgagatcacggatatggagttcacccagttccacccgaccctccttgtgaaaaacgggactgtttacggtctgatttctgaagcagtgagaggagaaggcggatatttagcagatcgcttcgggcgcaggatcatggctggcagacacgcgcttgaggatttggcgccccgggatgtggtttcacgggcgatttatgaagaaatgatgaaagaaaatcctgtttttataaattgcagccgaatagccgattttaacaaacgttttccgaccataacagaaatttgtcaaacagccggcgttgatcttgaaagcgggatccccatagcacccggaatgcattttttaatgggcggagtaaaagccgatacatgggggaaaacgtccgtgcctgatttgtacgccataggcgagaccgcctgcacaggcttgcacggggcgaaccgccttgcgagcaactcactgctggaagcgctggcaagcgggcaacgatgtgctgaacatatcattcaaacaccgttaaacggaagatataaaaaaaccccgaagaaaactgatgtcatcttacaagtgccggacacaacgattcatgtgcttcaagccaaaatgacaaccggagcgggtatcgtcagggaaaaagaaaacctgcaggcgctgacatcctggcttaacaacgtatctgtgcatcatataaatgtgaaggatatcacaatggaacaagcagagctatcctgcctatggaagactgcgcaacttgttgtcacctcagcccttattcgggaagaaagcagaggcgctcattttcgtactgattttcccgggacggagaaagattggcacggaaaacaaatcattcattcaacatctggaacggttatcagaaaaaacgaaaggattggggaactatggacattctgcagctgaaacaaatgctgactcatttttttcaggaagatatcggaacgggtgatgcgacgtcacaagcgattttttctgatcagcaatgtaaagcgcggatcatcgcaaaaacagacggcgtgtttgccggagaagacgttatccgtgaaggatggaagcttttacacgatgatatccgcatccgccctctgaaaaaagacggagaacggatgaaaaaaggagatgtgctcgctgaaatggaaggccgggcggcagctcttcttactggggagcgggtcattctgaatctcatacaaagaatgtcaggcattgcgacaatgacggacgaggctaaaaggcgtcttgatgatccgtccattaagctttgtgatacgagaaaaacgacaccggggctcagaatgctggaaaaatacgccgttcgggtcggaggcggctttaatcatcgcttcggcttatatgacggcatcatgattaaagataatcatattgccgcctgcggatcgataaaggcggccgtggagcgggcaagagaaacggcagggcagatgcttgcggtggaagtcgagatcgaatccgaacagcagctgctcgaggcaatagaagcgggcgcagacattattatgtttgacaactgtccgcctgagtccgtccggcgttttgcaggcatgacaccgggccatatcaaaacggaagcatccggaggcataacgctcgacacattgcccgcttataaagggacgggcgtccaatatatttcactcggatttctgactcattcagtaaaaagcgccgacatcagcatggatgttgaggctgcggaacagggggatttttaagatgtctatttttgacgtgttaactgcatcagccgaaatgatgccgagccattataaagacatgagcaccggagaaatggaaaagcgtgtcgccgccattaaacgggatttcggaaagcgcctgttcattccggggcatcactatcaaaaagacgaagtgatacaattcgccgatacggcaggtgactccctgcagcttgctcaagtggcagaaaaaaataaagaggcggaatatattgtgttttgcggcgtgcattttatggcggaaaccgctgatatgctgactgatgataaccaaaccgtcatattgcccgacatgcgcgccggatgctcgatggctgatatggcagatattcagcagacggacaaagcatggcaagagcttcaagaactgtacggtaacaccatcattccgttaacatatgttaactcgacggcggaaattaaagcattcgtcggtcggcacggtggagcgaccgtcacctcttcgaatgcccggagtgtgctgaaatgggcttttaaacaaaaagaaagaattttatttttgccggatcagcatttaggcagaaatacagcctatgacctcggcattccgctgacagaaatggctgtatgggacccggggcagaaccgattgcttactgaccatccggaaaacattaaagtcatcctttggaaaggacattgctccgtacacgaaaagtttacagcggaaaatatttttcagctgcggcagcgggattccggcatccgcattatcgttcatccggaatgttcgcgggaagtggtctcgctcagtgacgacagcgggtctaccaaatatattattgatacgattgaacaggcagaaccgggaagcaagtgggcgatcggcacggaaatgaatcttgttcagcgcctcattcactcgcacccggataaacagattgaatcattgaatcccgatatgtgtccgtgtctgacaatgaacagaatcgacctgccgcatttattgtggtcgcttgagcagcttgaaaaaggcgagccgaagggtgtcattaaagttccggaagcggttcggacagaagcgcttcgtgctttgaacagaatgctgagtcatacgtaatcataaaaatttcccctccttcccaaattttttatcatcatgcccagtccaccggcatatagtgtgaagaaacgtattgtaatgacaaatgtaccgttcacgttttgtgcataggaggggaaaacgttgaaaattcatatcgttcaaaaaggcgattcgctctggaaaatagctgaaaaatacggagttgatcttgaagagttaaaaaaactgaatcatcagcttagcaatccagacttaattatgcctggaatgaagataaaggtgccttcagaagccgttccggtcagaaaagaacccaaggccggcttcggaacgtctgcgcataagcatgagcatccatatgccaaagaaaaaccgaaatcagttgtggacattgaagacaccataccggaagaaccgaagccgtcaattccgtatgtgccgccaatccctgaaaagcatgaaaatgtgctgccggaagctgatatgaaccaatattatccgtccaatcagctgtttcagccgtggtcgcctcctaagccggaggaaccggtgacacattttgtcgagccgaaagaaaaagagcatgacaataacattccacaacaggaggaaatgatcaacatggaaaacgcgaattacccgaatatgccgaaggcgcctgaagccggaaagatggaagaagaaaacgccgcttatcatctgccgaacatgccaaacattccgaatgtcccgtttccgaatatgccggccgttgaaccgccttttatgcattacccgatgccgtgcatgccttgtccttgtccggttccggtgacaccgatgctgccgggttcgggactatgccatccgtgcttcccggtaggcggaggtttcggcggttttggaggaggttatggaggctttccggtaatgccgatgccgttaccgtacggattccatcatcacggattccatcatccgggatttgggccgcaagcgggttacggtgaatatgaaaaccaggcccatgaaaatgcagagcattatgatggttctgcatccggtttcggcggtgctccgtacggtcaaatgccgtattacggcggatattcgtctcattacgcaaacgcgcctcatcatgatgggaaatttaaggatgatgattgcggctgccatgattcacatcaccaccaccatcatcaccacggttcacatcaccatcacgcaaatatgcctgtgcagccgtatccgaatgtgggtgcaaacgccggatattttatgccttacggcggagcaaatcctaatgccgcaccgaatcagccgagtccaaatcaagtattcggacggccggaggaagaagaagattaatgtttcgggacgatgtatgtcgttcctttttttatgtccaactgaggaatggacataactgacaagcttaaacccgccgtcggccgcacatcctaaacatgagcggaaaacgctcaaacagcgatgaatccacggggggtttttccattgggtaaaaaactgatgacgatcgcaggcgttttagccgtgacggcaagcttaacggcatgcggagcaaataatgccatgaatgacggacgctacaatcagtcaacacgtccggtcggatattattcgaatgataatgataacggcagacgccagtacggaatggaccatcaaggacccgtttctgaaatgatggaaaaccgaaacggccgtcataatacgacaaacgtgtctgaccagtatgcgcctaatgacggggttccgttaacgacggacggcacatataacggccgaaatgtcaatacgccgccggcagctatgtcttataatgggtatgacaacgccgaaaacatcaggctggcggcaaaagttgcaaaccgcgtgaaaaaagtaaaaggcgtacaggatagtcaggtcatcgtgactgacacgagagtcgtcattgctgtcagaacaaatcatccttttacgaaaaatgatgataaacatgtcaaacatgcggccaaaagatttgcggacggccgtacaattcaagtgtttaccgacaacgctacttttacaaagctgcaagacatgaacagaaacagccgttaaacgggactgccggatgatttcatccggcagtatttttatggataaagcttcatcatttctttacatattcttaaaacgctctttatgttgcggtgttaacataaaagtaataaaacgtaacggaggggccggaatgaaaaaaacggagcatgacaaaagccgcggagaaaaaactgtgtatctgaccgtaaggggataccggctcaaactgacgtccggacaaatgaaactgatttcagccggccgggcataatcatcggggcagccttcataatagaggctgcttttattcggctgaaacagacaaatgaaagaaaacggttaagcaccggcatctttggtcaaactagcatcaagagtttgattgaataaagaggtgttattggtgaaacgaatttgcggtgctcgtctattgtttatgcttatcttatcggctgcagtcctgatttgcggaggaaaaggcgcatacggggcggaggttgagcattacgggccgcttcgggtgcacgtccagctggaaaaggtctatctggacggtgatgtcggcatcgaacatacggatgaaaccgttttggcgatggaggatttttgggccgcatatgcgggctggacgctcgttgagcagaaaaaaggcttcgttcttttccgtaagcatgttgatgacatttctccgctcagtaaggttaacggttatatcggcgtcacggacggaggcgtcatctccacttttcacggccgtcccggatcgctggccgagccgatccaatctttcttccagattgatatagaaaggctggaaagccgattgcaaaagcacttggaacacggcataccgtacaggacaaaagcggagtttgagagcgtgatcgatcatattaagacttacagcggatgactttgacgcaagacatgtgacacatgtcttttttttctgaatggaagatgtcaaagcgaacatacgttaacttttctataagactttggctgtttttgtgttacaatgataagcagtcaaagaggtgaataggtgtgattgaattcgtgaaggggacgattgattatgtatctccccaatacatcgtgattgaaaacggcggaatcggctatcaggtcttcactccgaacccgtttatttataaggtaagcaatcaagagaccatttttacgtatcatcatataaaagaagacgccttttctttgtacggtttttcaacccgggaagaaaaagcgcttttcacaaagctgctgaacgtcaccggcatcgggccgaaaggggcgctcgccatcctcggttccggtgaccccggagccgtcatcgaagcgatcgaacaggaagatgaagcctttttggtgaaatttccgggtgtgggcaaaaaaacggcgcggcagattattcttgatttgaaaggcaaactggccgacgtcgtgcctgaaatgattgacaacctgttcaatcatgaagcgcgcattgaaaaacaagaggctgaaacggcgcttgacgaggcgcttgaagcgcttagggttctcggctacgccgaaaaagaaattaaaaaagtgcttcctcacttaaaagaggaaacggcgctttcaacagatcaatatgtgaaaaaagcattgcaaaaattattaaagtaaggtgatgttcatggatgaacggctcgtttcaagtgaagcagacagccatgaatcaataatcgagcaaagcctcaggccgcagaatctcgcccagtatatcggccaaaagaaggtgaaagaaaatctgcgcgtgtttatcgatgcggcgaaaatgaggcaggaaacgctggaccacgttcttttatacgggcctccgggtctcgggaaaacaacgcttgcgtctatcgtggccaatgagatgggggtggagatgcggacgacgtcaggtcccgccatcgaaagaccgggagatttggcagccatcttgacggcgctcgaaccaggggatgtgctgtttatagacgaaattcacaggctgaaccgctcgattgaggaagtgctgtacccggcgatggaggatttctgccttgatatcgtcattggaaaaggcccgtccgcccgctccgtccgtctcgaccttcccccttttacgcttgtaggagcgacgacaagggtcggattattgaccgcaccgctcagagaccggttcggggtgctgtcgcgtcttgaatactatacgcaggaagagctgacagatatcgtgtcaagaacggctgacgtttttgaagtggatatcgaagaagctccggctctggagatcgccagacggtcaaggggaacgccgcgggttgcaaaccggcttctcagaagggtgagagattttgcccaggtgctcggcgacagccgcatcacggaagaaatcgctcacgacgcgctcgaacgtcttcaagtcgatgcgctcggccttgaccatatcgaccataagctgctgatgggcatgatcgaaaaattcagcggaggtcccgtcggccttgatacgatttccgcgacaatcggcgaagaaccgcatacaatagaggatgtgtacgaaccgtatctgctgcagatcggatttctccagaggacgccgaggggacgggtcgtgactccggctgtgtatgaacattttcgattggaggcgcccgcccgtgactgactttccgaaggttctcatggttctcggtgccgttttgcttattgccggcgcagtctggcactttgtcggaaggctgcccggagatattttcgttaagaagggaaatgttacatttttctttcccgttgtcacttgtattgtgatcagtgtgatactatccattctgcttaattttttcggcagaatgaaataacaatagacagaataaaggtgaaatgatgaaagtcgatttatttgattttgaactgcctgaacgcctcattgcccaagtgccgctgaaagaacgtgacgcatcgcggctgatggtgctcgacaaacagacgggcgggctgacggacagttcatttaaagagattgtaagcttttttaatgaaggggattgtctcgtcttgaacaatacccgtgtgctgcctgcaagattattcggcacaaaagaagatacgggagcgaaagtggagcttctgttattaaaacaggaagaaaatgatacatgggaaacgctcgtaaagccggcgaaacgcgtaaaaaaaggaacggtcctgacatttggcgacggccggctgacagcggtctgcacggaggagcttgatcacggaggcagaaaaatagaattccggtatgacgggattttttacgaagtgcttgaatcactcggtgaaatgccgctgcctccttatattaaagagcagcttgatgataaagaacggtatcagaccgtcttttcaaaagaaatcggatctgccgcagctccgacggccggacttcattttacggaagagattctggacgagctgaagcaaaagggtgtgcggattgaatttatcacacttcatgtgggactcggcacattccgcccggtcagtgcggatgatgtggaagagcataacatgcacgcggaattttatgaaatgacggaagaaaccgccgcctctttaaacgaggtcagaaaggcgggagggcgcatcgtgtcggtcgggacgacatcaacgcgcaccctggaaaccattgccggcgagcatgacggcgtatttaccgcttcaagcggctggacgtccatattcatttatccgggatatgaatttatagcgattgacggcatgatcaccaattttcatctgccgaaatcttcccttatcatgctcgtttctgcgcttgccggcagagagcatgttctttccgcctaccgtcatgcggtagaagaggaataccgtttcttcagctttggcgacgccatgctgattatctaatttgaagacaggaggcctcatacaaagtggctgaacaaccgatacgttatgaatttataaaggaatgcaaacaaacgggagcgcggctgggcagagttcatacgccccacggctcctttgagacgcctgtatttatgccggtcggcacgcttgctacggtaaagacgatgtctccggatgagctgaaatctatggatgcgggcattattttaagcaatacgtaccatttatggctccgcccgggacacgacattgtaaaagaagcgggcgggcttcataagtttatgaactgggaccgcgcgattttaacagattccggcggttttcaggtcttttcattgagcaagtttcgtaatatagaagaagaaggcgttcatttccgcaatcacttaaacggagacaagctgtttttatctccggaaaaagcgatggaaattcaaaacgccctcggctctgatatcatgatggcgtttgatgagtgtccgccgtatccggcagagtatgattacatgaaacgctctgtggaacggaccagccgctgggcggaacgctgcctggaggcgcacgggcgctcagatgagcaggggctgttcggaatcgtacagggcggagaatacgaagacctgcggacacaaagtgcaaaagacttggtttcgcttgattttccggggtatgccataggcggattatctgtcggcgagccgaagcacgtcatgaaccgagtgcttgagtttacaaccccgcttttaccgaaggacaagccgagatatttaatgggtgtgggttcaccggatgccttaattgacggcgccatccgcggcgtggatatgtttgactgcgtactgccgacccggattgcccgaaacggcacggtgtttacgaatgaagggcgtctgaatatgaaaaacgccaaatatgagcgtgatttccgtccgattgacgaagagtgcagctgccatacatgccaaaattactcccgcgcttacatcagacatttgatccgctgtaatgaaacgtttggaattcgattaacaacttaccataaccttcattttctgttacacttaatggagcaggtcagacaagccatccgggaggatcgtcttggtgatttccgagaagagttctttgagcgttacggctataataagccaaatgcgaaaagcttctaaataaaaccattcatgaaaggagggaaacagatgggtactttaggcacaatcgttcctattattttaatgtttgcagtgctttatttcctgctcatccgtccgcagcaaaagcagcagaaggccgtccgccagatgcaggaagagctgaaaaaaggggattcagtggtgacaatcggaggattgcacggcactgttgattcaattgatgaaagcaaggtcgtcattaaaacaggtgataacacccgtttaacatttgaccgccgcgcaatcagagaagcttccgctgaataacagcgaagctcatacatacaaaaaaagagcggagaatccgctctttttttattacgctgatctgcttcctttcaaattcactccgaaaatgccgcccagcatactgactcccaaaaagccgagatgaaacaaaagctgaccggatgtaaacgtttttccgaaccctaaatattgaaaaagcaagatgattaatgaaaaacagacggcggttaacgctccgatcatccagcctttttccttcgctttgccgcccgatataaaacctcccgcaaataaagaaagaaaagaaagcgcggtgatcagccagctgaaagatgattcttccattgaggtgactgtcagtaaaagcgaaatcgccaaactcgtaagaagcatcaccgcaaaaatagccactaagccgtacaaaacgcctcttcccacttgtttcgtttcttccatttttatctcctctccgctctgcggcctgatatatgacaagccggagcccgtctttttctaaatgtattctctgaatgttcgaattagacgtaaatgcatgatgttcagcccgtttcttacataattcagagccgatggcaaatgctatgaccgttggaggtgcgatatggaagatattttcattattacgtttcgtacgattgtgctttattttatcattcttgtgattttcagactgatgggaaaacgggaaatcggagaactgagcattttagaccttgtcgtctccattatgattgccgagattgccgtattggcaattgaaaatgtaaaagataagcttttgcatacaattgtgccgattgtcgttttaatgattattcaagtaagccttgcttttatttcgctcaaaagccaaaaaatacggcagctgcttgacggaaaacccaccattattataaaacagggaaaaattgatgaacgggcgatgagatcgcagcgctacaattttgacgatcttcttatgcagctgagggagaataacatcgatagaatctctgacgtatcgtatgccattttggagtcttcgggcaaactgtcaatcgtcaaaaagaaaaacaataaggataagcagatggaaacatcgcttatcgttgacggggtcattcagaacgagcatctggacagaatcgggaaagataaacactggcttgaaaaaaatttagcaaaaagaggatatcgcgatctttcggttatatcattctgcacgtttacggacggcgctttttttattgatctcaaagatgaaaaaggggagccataaatcggcttcaccgcgtcacgaacttgccgatgaccggaatccggatcagctcttcccttttaatcagcctgaataacagcagcagcgcaatgtacaaaatcgcggtcattgcaatccagcctgtgagattaacagcctctgatcctgaaaaatgaacggtgtgcttgatgatgcggctgacataaccgcaaatgaatatgacggcaaaacagagcgcgtattcttttattttaatgctgatcggaagcaccttgcttacggtggccgcatgcagcagggtgacaaggaccatccccgttacaatcgcaagtgcggcgcccatgatgcctaaggaaggcctggtcgccaaaacaaaaattaggccggttttgacagcggcgccgataaaactgttcatcatggcggccccggctaaattgagagcctgcagcaccgcctgaagaggcccctgaaaatagtaaagcagaaaaaacggcgccatcactttaacaaataccgccgcattagttgatccgtacatgacggacatcagttcatcagcgaaagagaataaaataaccaccgaaatgcctccgcttaaaagacacagcctcatcgcctgttccagacggtattctacaacttgcagctttttttgctccattccttcactgatcgcaggaacaagcgccgttgacagagaataggttataaagctgggcagcgtcaaaaccgtcatggcaaatccggtcagctccccgtactggctggtggcggcagcggtggccactcctgcaatcgcaaggctctgcgcgacgacaataggttcaaaaaaccaagataaatttccgatgaagcggcttccggttgtcgggagcgacacgctcatcagctggcggaaggtttcttttccatttgcaatcgacttgaaaaattgttttctgattctgattgttttatttgctttaaaacaaatgaataaataaataagagaggcaagctccccgatgacagacgaaatcatggctcctgctgcggcatattcaatcccgtacggcagaaacaccgtcgtgcagactgcgacaagtgaaatccgcacgatctgctcaagcacttgggaaaacgccagcgggttcatattctgcctgccctgaaagtaaccgcgcagcacgctggatatcgcgataatcggcacgacgggcgtaatcgccagaagcgggaaaaccgtgcgctgatccgtcagcatcgtttctgacataatcggcgcaaagcataaaaacagcggcgtgaagatgagacttaatatcccggtgacggtaagcgccatcactaaaatgtgtttcattttctgccggtccccccgcgcgcttgcttcagcgacaagtttgctgatggcaacggggaggccgaattgagtcaaagtggtggccaagaaaaatgtcggggcagccatcatgtataaaccgaccccttcttcaccgataaaccgggcgataaccacccggttgacaaagccgagcattctcgtaatcatcccggctgcaatgagaataagagtgccccttaaaaaagtctgttttgccattttataaacccctgccttctcaaactacctggaatcatatacaataaagatatgcgccgatgtcgtccgagcatgacaagtcttcgagaaaaatggaaaaaggagcgagcgcccagtggagaaacatcccgccgaaatgtacaaagatcatttgcggcctttcttgtacagtaaacttgaagagttcaaaatccttggatacgatgatgttgagcacgagagtttatggtcatacttaatacataaaaagtggaaacagaaaaaggaattgccgctgcatgaattggccggtaatattttatcagttaaaattggcgattttatgaactatgcaaccgttgaagcttttaagtcgtctaattggctggaaagcgatgagggtcaggaagctttggatgaactgctgagataatgatttgacggcataggtttaaggaggaaatacataatgaaaaaaggacgcttgattgcgtttttcctgatcgtattattgatcggcacagggctggggtattttacaaaaccggctgccaataatattacgttaggattggatttacgcggcgggtttgaagttctgtacgatgtgcagcccgtcaaaaaaggcgataaaatcacaaaagacgtgctcgtcagcacggtgcaggcgctgaaccgccgggctaacgttctcggcgtaagcgagccgaacattcagattgaaggaaataaccgcatacgcgttcagctggcgggcgtcacgaatcagaacagggcgcgcgaaattctgtcaacggaagcgcagctctcgttcagggatacgaatgataaagagctgttaaacggctctgatctcgtggaaaacggcgcgaagcaaacctttgatccgacgacgaacgaaccgattgtcagcgttaagctgaaggatgcggataagttcggagaagtgacgaaaaaagtcaagaaaatggcccctaataatcagcttgtgatctggcttgattaccaaaagggcgattcatttaaaaaagaagtcggcaaaaaacatccgaaatatgtatccgctccgaatgtgagccaggaattaaacacgaaggatgtcacgattgaaggtcagttcaccgttcaaaaagcgaaggacttggccaatattttaaacgcgggtgcgctgcctgtgaaactgaccgaaaaatactctacttcagtaggggcgcaattcggacagcaggctttgcatgatacggtagaggccggcatcatcggtattgcaattgttttcttatttatgctgctttattacagactgcctggactcatagcggtcattacgctttctgtatacgtgtatattacgcttcaagtgtttgactggatgcaggcggtgctgacgcttccgggtattgcggcgctcattttgggtgtcgggatggcggttgacgccaacatcatcacctatgaacggataaaagaagaactgaaactcggcaaatccgtccgctcagctttccgttcagggaacagacggtcatttgcgacgatctttgatgcgaacatcacaacgatcatcgcagcggtcgtgctctttattttcgggacaagctctgtaaaagggtttgcgacgatgctgattttgtcaatactgacaagctttattacagctgtcttcctttcaagattcctgctcgcccttcttgtggaaagcagatggcttgaccggaaaaaaagctggttcggcgtcaagaaaaaacatattatggacattcaaaaaacagatgaaaatactgaaccgcatacggcattccagaaatgggatttcacgagcaaacgaaaatatttctttattttctcaagcgctgtaaccattgcgggaattatcatcttactggtctttaaactcaacctgggaatcgattttgcaagcggtgcgcggattgacgtgcagagcaatcatgcattgacggcgcagcaggttgaaaaagactttgactctctcggcatggatccggaaaacatcgtactctcgggtaaagagaaccatgttgccgcggcccggtttgtcggagagccatccaaagaaaaaatcgctgaaatcaaaacgtactttaaggacaaatacggatctgaaccgaacgtcagcacggtatcgccgacagtcggaaaagaactggcccgtaatgctttatatgccgtggcaattgcatcaatcggcatcattatttacgtgtcaatccgtttcgagtacagaatggcaatcgccgcgattgtatccctgctgtatgacgctttctttatcgtcgcgtttttcagcattacaaggctggaggttgacgtaacctttatcgccgctattctcaccataatcggttactcgataaatgatacgatcgttacatttgaccggatacgcgagcagatgaaaaaacgcaagccgaagtcatttgccgatctggaacatatcgtgaatctgagtttgcagcaaacctttacacgttcgatcaatacggtcttgaccgttgtgattgtggtcgtcgtgctgctcattttgggctcatcgtcaattacaaacttctccgtcgctttattggtcggtttattgacgggcgtttattcctctctttacatcgccgcgcagctgtggcttgtatggaaaggaaaagaatttaaagggaaaaaatcaatcgaagagtaaaaggaaacaggctgtcttccggaaggcagcctgttttttttaggccgcattgaacttaaaacctgcatttgctataatgacatacgcttacataatcaatcatcattgttaaaacatgtaggggggttcttatgaacgttcgtgagtcggagcttccgggcatcggccagaaagtagaagtcattacgaaaaatcacgataaaatcagtattattcttcatgatgacggcagaaaagagctctattacttcgatgagaatgattatgacgaatgcttggcatccgttgaatttaacgacgaagaggcgaggcagatttccgctattttaggcgggatgacgtataagccgaaagcgctggaatctgtggaagtcgcgcttgatgacctcgtcattgagtggtttaaagccgaatctcatgcaccggctgtcagccgcacaatcggagatttggagatcaagaaacattacaacgtccagattattgcgatcgtgaagaaaaaccggcaaaaacagctgagccccggcattgataccgtaattgaagaaggggacaccctcgttatatcgggagaaagaagcggactgaaaaagctggtccgcgagcaattaacggcccggatttcctgagaccggggtttactcccgggaaaatgggggaaaagataagaatcaataattgggggcagacgcatgaataaacaatggactattatattcgctttactatttactctgattgtcgccatctttgctgtcattaacgtgcgggcggttgaggttgattatctgttcggaaccgctgaatggccgctgattttagtcattttaggctctgtgttaatgggagcgctgatcgtgttttcagccggtatatttcaagtgatgaaactgaagcgcgaaattaaaatgctgcggaaagaaaacagatccgcaggtgaattgacggctgattcggacggcaaaaaaacagccgcgccgccggaagaaatgcttgaagagaaaaaaggatcagaataacatttgaaacccctcagtccgctctagtataatagggtggttgaggggtgaatttatgttagcgtcaaaaatgcgctgggaaatccagcagccggatcaggaaaaagtcaaatcactcacagaacaattggacataacacctcttgtggcatcactgcttgtaaaaagaggttttgatactgccgaaagcgcaaggctgtttttacatacaaaggatgcagacttttatgacccgtatgaattaaagggaatgcgggaagcagttgatcggataaaactggcggtttctcaaggggaaccgattatgatttacggagattacgatgcagacggcgttacaagcacgtcagtgatgctgacggcactcagacagctgtcggcggacgttgacttttatattcccgaccgttttacagaaggctacggcccgaatgaacaagctttccgttccataaaagagcggggattttcgctgatcattacagtggatacgggaatcgccgccgtccatgaagctgaagtcgcaaaagagctgggcttagacgtcattattaccgaccaccatgagccgggacccgagcttcctgacgtatttgcgatcatccacccgaagcagccgggatgcggctatccgtttaaagaattggccggcgtcggtgtggcgtttaagcttgcccacgcgcttacgggttctttgccggaagctatgctggacttggcggcaatcggtacggttgcagatctggtgcctcttcatgatgaaaacagattaattgcgtcactcggaattgaaaggcttcgtacgacaaatcggccgggcctcaaagctctgattaagctttccggcggagatatcggacaagctgatgaggaaacgatcggatttcaggtcgcaccgaggcttaatgccgtcggaagaatagaacaggccgatcccgctgtgcacctgctgatgaccgaagatcagtttgaagcggaggaactggcttcggatattgaccggctgaataaagagcggcagaaaatggtgaaaaccatgaccgaagaggctgttgaaatggtacagcagcaaggcggaaacccgtctgccattgtagtggcaaaagccggctggaatccgggtgtcgtcggtattgtcgcatcgaagctggctgaacgtttttaccggcccgctgttgtgcttgggatagatgaggagcagggaatcgccaaagggtcggcgcgaagcatcagaggcttcaacctttttacgagcctttcacagtgcagagacattcttcctcatttcggcgggcatccgatggcggccggaatgacgctgaaggctgaagatgtggcggaattaagggacaggctgaatcaaatggctgaagaaacccttacggaagaggattttattcccgttcaggaggttgatcttgtctgcggcgttgaagacataaccgttgaaagcattacagaattgaatatgctgtcgccgttcggcatgcttaaccctaaaccgcatgtgatggtgaaaaatgccgtgcttgatgatgtgcgcctgatcggagcgaataaaaaccacgtgaaaatgacggtgaaaagtgattccgccgtccttgactgcgtcggctttaacaaaggagagctggaagccggagttgttcccggatcaacgatttccattgtcggcgagatgtccattaatgaatggaacaacagaaagaagccccagctgatgattaaagatgctgcggtgccggaatggcagctttttgatattcgaggcaagcggacgtgggaagatacggtcaccgcactgccgaaggaaaaacgggtgctcatcagctttaacgaaaaaaccgctcagaagctccgtgaaaaagagctgacgggcgagcttgccgagatcacttcggaatccgaggcggaagctctccagcttgacggaaaatatgccgtttttctggatgtgccgccgtcagcggatcgcctgcagcatttgcttgacggaaagaagccggaacggatttattttgtttttatcaatcatgaagaacatttcctgtcctcatttccatcgcggaatgatttcaagtggttttacgcatttctcttgaaaaggggcgcttttgacttcggcaagcatggttcagagcttgcgagacacagaggatggtcaattgacacaatcaatttcatgacaaaggtgttttttgatctcggttttgttaaaatagaagatggtgtgctgtctgtcgtgagcggtgcgaaaaaacgcgacctggcagattcgcaaacctatcaggtaaaacagcagctgatggaattagaccagaagctcaattattccgcagcccatgagctgaaggaatggctgaataagctgatgaaccaaggttcagaggcttatgaaagtacgaggaggacatagaacagatggatcttaaaaaatacgtaacaattgtgcccgattacccgaaagaaggcgtacaatttaaagatattacgacattgatggacaaaggcgacgtataccgttacgccactgaccaaattgttgaatatgcaaaagaaaaagaaattgatttagttgtcgggcctgaagcgcgcggctttattatcggctgtccggttgcatacgcactcggagtcggctttgcgccggttcggaaagaaggaaaacttccgcgtgaggtcattaaagtcgattacggtttggagtacggaaaagacgtactgacgattcataaagatgcgatcctgccgggacagcgtgtgctgattactgatgacttgcttgcaacaggcggcacgatcgaagcaacgattaagctagtcgaagaactgggcggcgtcgtagccggtattgcgttcttaatcgagctttcttaccttgacggcagagacaagcttgacgattatgatattttaacattaatgaaatattaaccgcatatggaaaaaagcactcgtgtcagggtgcttttttcctattatttcatcatcctgacagattctttaggtgttttgaacttctgccctttacatctctcgtttttttcttgataataaactaatacagtttacatttaaaaaaggtgattccatggcgaacgaacaagtattgactgccgagcaagtaatagataaagcgcgcacttatctgccggaggagcagattgcgtttgttgagaaagcttacctgtatgcgcaaaacgcgcatcgcgaacagtaccgcaaatcaggtgagccgtacatcattcatccgattcaggtggcggggatcctcgtcgatttggaaatggacccttccacaattgcgggcggatttctgcatgatgtggtggaggacacggatgtcaccctcgacgacctgaaggaagtattttctgaagaagtggcgatgcttgtcgacggcgtgacgaagctcggtaaaattaagtataaatctcaagaggagcagcaggcggaaaaccatcgaaaaatgtttgtcgctatggctcaggatatcagagtcatattgatcaagctggcggatcgccttcacaatatgcggacgttaaagcatcttccgcaggaaaagcagcggagaatttcaaatgagacgttggagattttcgctccgctggcccatcggctcgggatttctaagatcaaatgggagctggaagacaccgctctccgttatttgaatcctcagcaatattacagaatcgtcaacctcatgaagaaaaagcgcgcggaacgcgaactttatgtcgaagaggttgtcaatgaagtgaaaaaacgcgttgaagaagtgaatattaaagcggacttttcaggacgtccgaagcacatctacagcatttaccgcaagatggcgctgcaaaataaacagttcaatgaaatatatgatctgctcgccgtccgtattcttgtcggaagcattaaagactgctacgccgtactcggcattattcatacgtgctggaagccgatgcctggcagattcaaagattatattgcgatgcctaagccgaatatgtatcagtctctgcatacgaccgtaatcgggcctaaaggcgatccgctggaagtgcagatcagaacgtttgagatgcatgagatcgctgaatacggggtggccgcacactgggcttataaagaaggcaaggctgcaaacgaagaagcgacatttgagaaaaaactgtcctggttccgtgaaattctggaattccaaaacgagtctacggatgcggaagaatttatggaatcgctgaaaatcgatctgttttctgacatggtatacgtatttacgccaaaaggcgatgtcattgaactgccgtcaggctctgtgccgattgatttttcctacaggatccactcagagatcggcaacaaaacaatcggggcgaaagtgaacggaaaaatggtgacgcttgaccataagctccggacgggcgacatcgtcgagattctgacgtccaagcattcttacggtccgagccaagactgggtcaaactggcgcagacgtcccaggcgaaacacaaaatacgccaattctttaagaaacagcgccgtgaagaaaatgtcgaaaaaggccgtgagcttgtcgagaaagaaattaaaaatcttgattttgaagtgaaagatgttttaacgctcgaaaatcttcaaaaagttgccgacaagttcaatttctcaaatgaagaggatatgtacgcggcggtcggatataacggcattaccgctcttcaggtggccaacaggctcaccgaaaaagaacggaagctgcgtgaccaggaagagcaggaaaaaatcgttcaggaagtcacttccgagccgaaacattatcctcaagggagaaaacgggaagcgggtgtgcgcgtaaaaggcattgacaaccttctcgtccgcttgtcgaaatgctgcaacccggtgccgggcgaccatatcgtcggttttattacaaaagggcgcggtgtatccgttcaccgggacgactgtccgaacgtcaaaacgaatgaagcgcaggaacgtctgattcccgttgaatgggagcatgaatcacaggttcaaagacgcaaagaatataacgttgagattgagattttggggtatgaccgtctcgggcttttaaatgaggtgctccaagccgtaaatgaaacgaaaaccaacatctcctctgtctccggcaaatccgaccgcaataaagtcgctacgattcatatggcgatttttattcaaaacattaaccatctgcacaaagtggtcgagcggattaagcagatcagagacatctattcagtccggcgggtaatgaactaaaaggagcttgctatgaaattagttgttcagcgtgtaacagaagcgagtgtgacggttgacggcgctgtcgccggccggatcggacccggtattatggcgcttgtcggcatcactcatgaagatacagaagaagatgccgcttacttggcggataaaatcgtgaatcttcggatatttgatgatgaaagcggcaagatgaatttatcgcttttggatacgggcggggagattttatccgtttcccagtttacgctttacggcgaaacaaagaaagggagacgcccgaattttatgaatgcggctaaaccggatcaggctgtgctcctttatgaaaagtggaacgaactccttcgggaaaaaggagtcaaagtggaaaccggaatattcggagccatgatggatgttcagctgacgaattccgggccgattacattgattatggattctaaacaataaaaaagctgccgttcggcagctttttttttatgattgaaaataatgttccaatccgctttcaattccgtctgtcactttttcctgataagagccgctatgtatgattgtttcttcttgcggttgactgagatagccgagctcatacagcatggcaggccgtttattttccctcaggacgtaataatcgccaaacagaacgccgcgatcaggaataggggaacgcttcactacttcagaatggacgtctgaggcaagctggcggtccttagacggactgtaataataagccgtgcttccccgcgttgacgtatcggcataactgtcatagtgaatgctgataaaggcatccgcattccggtaatgagaggttgaaaccctggcctgcaggctgataaatgtatcatcctgtctggtgatatacacgtttgcaccggccgctctcaattttccggctaacagcttagctgttttaatcgttacgtttttttcaaactttccggagtagccgatcgttccgctgtcttttcctccgtgtccgggatcaacgacgatcgttttgtttttaagtgagccgctgccgcctgacgtgttgggagaaggtgcttcgcctgtttcctcaccgctttttgacgtttgtacgacccagtctgccacatatgcggtttgtccgttttcaagccggacttcataccatttgccgcttgagccgacaatcgggtaggctgcgcctttatctgccctttttacgatagaagcggaagtcgaggccgagctccttaagttggtgccgccgtaaacaatatacgcttttttcgaggagcctgagcccgcagaaccgtctcccgagccggatgcgctgcccgatgagtcagaatcctttatgatgtagtggcttgctgcccagcctttttgcccgtttgcttcaattttcagccagccgtggtcttcacttaagatggaaacctttgttccgcgtgataatttagtcataatcgctgaatcatgtgacgctgcacttctgacattcaatgaagaaacgccgaccgtcccgctttttgacccgcttcgggccgaagttgctttcgtatccgatccgccgctgtccgcggtgacgtattcggaagaaacccacccggttgtgccttgataagaaatgttcacccatccgctgttcttgtccagcacggatgcatgcgcgccttgcggaagtttgccgatgacttcatacgatgtccccgggccttttctgatgcggaggtcaggatcggtggaagtgaccgttccgctttttgcggatgaattgtctgctcccccggctgtttttgatatcagccaggaaacgacccatccggttttaccggggctcagctgaagctgtacccagtctccctcttctttaacgatcgggtatctttcccctttttttacttcagcctttattccgtagctcaggccgggaccgcctctgacattgatcttgtctgtcgcgatgaccgcttctccctctgcggcgattgcggtgtgaaatgacggaagaagcgctgtgatgatgacgccgcataaaataagagcaagagttctcttcttcatggctgtcctcctttctgaactaactaaaatacattcttgtataatatcgtattttccttgctgaatgttaaataaaaataaaatggtttgtttatactagtcataaatacagcgaaaaggtgtgcaaatcatgaaatatcaaccaaaaatgggacgcgcgctgcacgatgcggaaggaaatctgcacttcagtgatcagagcgatagagaaaaggcgggttttcttgaagagacggcgacggagttcggtctcttatcgaaagaagcggtcgcaaggaaaaacagacggaataaaacttgacaggggagtgcaatcccattattataatagaaattgatgtacataactcatgataacgattttgaaccgataatggagaagagtaggtcagaatgcatggaaaagagaggaaccgtcccgggctgaaagcggatccgcactgcatctttctcgaaacaacactccggaggttccctgctgaacgcttttgcaagtcattaggcagcggacgtgaacctgcgttaaaggtcagagcggggatgcttcggcattccaactagggtggcaccacgggtataactctcgtccctactatacatgtatagtaggagcgggagtttttttatttgaagaaagacattaaggaggcctgtaacatggcatatcacattccaagaggcacacaggacatactgccgggtgaatcagacagatggcagttcgtcgaacaaattatgagggagacgtgccgcacttatcaatataaagaaatccgcacgccgatcttcgaacatacggaattattcgcaagaggcgtcggtgagtctacagatatcgtgcagaaagaaatgtacacgtttgaagaccgcaaagggagaagcttgacgcttcggccggaaggaacagccgccgcagtccgcgcgttcaatgaaaataaattatttgcgaacccggtgcagccgacgaagctttattatgtcggaccgatgttccgttacgaacgtccgcagacagggcgtttccgccaattttatcaattcggaattgaagcgatcggctccaaagatccggccgtggatgcagaagtcattgcgcttgcgatgagtatttaccgtaaagccggtttgaaacatgtcaagcttgtgctgaacagccttggtgaccaggagagccgcaaatcctaccgggaagcgctcgtcaaacattttgaaccgcgcatcggagaattttgctcagactgccagtcgcgtctgcacacaaacccgctcagaattcttgactgcaagaaagacagagagcatgaactgatgaaaacggctccgtccattcttgattacttaaatgaagaatcagccgcttattttgagaaagtaaaacaatacttaaacggtctcggcatcccgttcgaaatagatccgaaccttgtcagagggcttgattattataaccataccgcttttgaaattatgagcaatgccgaaggattcggagcgattacaacccttgccggcgggggccgctatgacgggcttgttgaacagatcggcggacctgaagcgccgggtatcggatttgcgatgagcatcgaacgactgctggcagccattgacgctgagaaaacagaccttcccgtcaatcaggggatcgactgctacatcgtgacgctcggagaaaaagcgaaggattattccgtttccctcgtgtacaaactgagagaagcgggcatctcaagtgaaatcgattatgaaaataaaaagatgaagggccaattcaaaacggctgaccgtctcggcgcacgttttattgcgattttaggggaagatgagcttgcccaaaataaaatcaatgtaaaagatgcggaaacaggagagcagcgtgaagtggtgttagacgagctgatacaagtgttaaaggcagatcaaaagcagtgaaggagaggaacgctatgtttggaagaacatattattgtggcgagataactgaaaaagcgattggcgaaaccgtcaaactgaaagggtgggtgcagaagcggcgcgatctcggcggcttgattttcattgatttgcgtgaccgctcgggtattgtgcaagtcgtgttcaaccctgacgtatcgaaggaagcccttgccgcagcggaagcaatcagaaacgaatatgtgcttgatatcgaaggcacggtttctgcccgtgaagaaggcacggtgaatcccaacctgaaaaccggtaaaattgaaatcaaagctgaagcggtgacggtgctcagtacggcgaaaacgcctccgtttccgatcagtgaccaggcggctgacgtttctgaagacgtccggttaaaacaccgctatttggatttgcgccgcccggcgatgtttcaaacattgcaaatgcggcatcaagtcacaaaatccatccgccatttcttggatgaaaacggatttcttgatattgaaacaccgattttaacaaaaagttctcccgaaggcgcccgtgattacttagtgccgagccgggtgcatgaaggggaattttacgcccttccgcaatcgccgcagatttttaaacagcttctgatggtgtcgggctttgaacggtattatcaagtggcccgctgcttccgcgatgaagacttgcgtgccgaccgccagccggaatttacgcagattgatattgaaatgtcctttatgagtcaagaggacatcatggctctggcggaagagatgatggcgaaagtcatgctcgaaacaaaaggcgttgaagtatcgcttccgcttccgcgaatgacatatgaagaagcgatgaacagctacggttccgacaaacccgatacccgcttcggcatgctgctgacggacgtgtcagacatagtgagagatactgaatttaaggtgttctcatcagccgtggcaaacggcggcgttgtaaaagcgatcaatgtcaaaggcgctgccggcgactattccagaaaagatatcgatgcgctcggcgtttttgccggaaattacggcgcgaaaggtctcgcttgggtgaaagtagaagctgacggcgtaaaaggcccgattgcgaaattctttgatgaagagaagcaggcaaaactggctgaagcgcttgatgcttctgaaggcgatctgctcctgttcggcgctgataagtttgaggttgtggctcaatccctcggcgcgcttcgcttaaagctcggcaaagaacgcggcctgattgacgaaagcctcttcaacttcctgtgggttgtggactggccgttattggagcatgacgaggaagaaggccgtttctatgcggctcaccatccgtttacaatgcctgtccgtgaagatcttgacctgattgaaacggcgcctgaagatatgaaagcgcaggcttacgacctcgtcttaaacggctatgaactcggcggaggctcaatccgtatttttgaaaaagacgttcaggaaaaaatgttcgggcttctcggctttacaaaagaagaagcggaggaggagttcggataccttcttgaagcctttgaatacggcgctcctccgcatggcggaatcgcgctcggcttagaccggttggttatgcttcttgcaggccgcactaacttaagagatacgatcgctttcccgaaaacggcaagcgcaagctgccttcttacggaagcgcccggcgaagtgagcgacgcccagcttgaagaacttcacctttctgtcaaaagaaaagtgaaacagtaaagatcggcagtttgtttcttgaaaatcaaaatctgctgtgatatgattttgacaagttaaataaagtcctgatgtgttagttgtacacctagttttgaccgaacatttttttgatttgggagcccgcatttttaaatggcgtacatgcctcttttcattcgctaaagaggacttacaagatttaaaaaagggcacccacctgctgagagcgggttcaaaacgaaggaaagctgcaacggcacaattgggactttattttttgtgcgctaaaaccagcggctttttgacaagccgagtttataaaaccagaatgtggagtgaggttcttgttacatcagttttccagaaatgagctagcgattggaaaagaagggctggacacgttaaaaaacagcacggtggccgttctcggcgtcggcggagtcggttcattcgcagccgaagcattggcgaggtccggagtggggcggatcgtgcttgtcgataaagatgatgttgacattacaaacgtaaaccgccagctgcatgcgctattgtcgacggtgggacagccgaaaacagaattgatgaaagagcggatcgctgatattaatccggattgtgacgtcgtcgccttaaaaatgttttatacagaagagacgtatgagcagttctttgagtatccgctcgattacgtcattgacgcgtcggatacgattcattataaaattcatctgatgaaagaatgtctgaaacggaatgttccgctgatttcaagcatgggagcagcgaataaaacagacccgacacgctttcagattgctgatatttcaaaaacccatactgatccgattgccaaagtcgtccgcacaaggcttcgtaaagagggcattaaaaaaggcgtacaggtcattttttctgatgaaagcccgatcgtcatccgtgaagacgtcagaaaagaagtcgggaatgatgaagcgaaaatccgcaaagcgcaaatgccgccgtcttccaacgcctgggttccgtcagtggccggtctgattatgggcggacatgttgtcatggagctcttaaaggacatcgacattaaacgggttaaagataagtaaaaagaaaaacagccttcttcaggaaaggctgtttttttatttgaatccgccgtttacacgaaagatcttgtccggttattttttctgcttcatcagtttttcatacacttgctttatggcggcttcaaatttccccgtttgtttcggtttatagtattgcttgttttttaacggatcgggcaaatattgctgttcgacccatccgttctcgaaatcgtggggatattgatagccgatcccgcgtccgagctcttgggcccctttatagtgggcgtcttttaaatgtttcggcacatcgccgattttacccgtcctgatgtctttgagcgcctcatcaacggctgaaatggcggagtttgatttcggtgagaggcataattcgattaccgcattggccagcggaattctcgcttccggaaagccgatccgttctgcggtctgaatcgcgctcagcacccgggggcctgcctgcgggcttgcgaggccgatatcttcataggcgatcacgagaagccttcttgatatgctttcaaggtctccggcttcgatcagacgggccagataatgaagggcggcgtttgcgtccgagccccggatcgatttttggaacgcggataagacgtcataatgcgcatcgccgtttttatcatgggtatagctttttttctgcagacattcttccgccgtttcccgtgtaatccggatcgtcccgtcgcttgattcctttgtggagagcacggcaagctccagtgcgttcaaagcggagcggacgtctcctccgcacccttgtgcgaaatgatccatcgcgtcgtcgtccaccgaaacgctgtaggaaccgagtccccggtgttcatctgtgagcgctcttttcaatgcctgcctgatcagatcgggtgttaacggttcaagctcaaatatctgggtccggcttctgatggccgggttaatggcatgataagggttggcggtcgtcgcgccgattaaaataatcatgccgttttctaaatagggcagcagaaaatcctgctttcccttatcaagtctgtgcacttcatcaaggattaaaatgacctggcctgacattttcgcttcctgtacgacaatctccatgtcttttttattatgaatgacggcattcaatttcctgaatgcgatgcttgtcgatcctgcgatcgctgtggcgatggacgtttttccgatgcccggcggtccgtacaggatcatggatgataagtgcttcgcacgcaccattctgccgatgattttatcttctttgaccaaatgttcctgaccgataatgtcttcgatattggcaggccgcatccgatacgccaatggtttcatgaacatctctccttacatatacagggtaacggaaaacggacgattagaaaagcgaattgcggcgggccccgtgtttcaatgaaaattaggataagttatgttataataacagttggtctataagatactaaacagattattcatatccatttacttgtataaattaacaattagaattgactggggtgttcatattgaaaatatcgacaaagggaagatacgggctcaccattatgattgaattggcgaaaaagcacggagacggtccgacgtcgctcaaaagcatcgcccaaacaaacagcctttctgagcattacttggaacagcttgtatcaccgctcagaaacgccggactcgtaaaaagcatcagaggcgcttacgggggttacgtgctcgggggccagcctgaagagataacggccggagatattatcagagtgctggaagggccgatcagcccggtagaagtgcttgaggatgaagagcctgccaagcgggagttatggatccgcatccgcgacgctgtaaaagacgtgctggacagcacgacgttagaagaccttgcgagctacacggacggcgagcaggaagcttatatgttctatatttaaaccagaggtgtaaagacaatggaacggatttatttagatcatgctgcgacttcccccatggatgaacgtgtgctcgaagaaatgaagccccatttcttcggcagtttcggcaacccgtcaagcattcattcattcgggagagaatcccggaaatgggtcgatgaagcgagagcggacatcgcgcgcgaaatcagtgcgaaagaacaggaaattattttcacaagcggcggtacggaggctgataatttagccattttcggaacggctgccgcccggaagaatgaaggaaagcatatcattacgaccgctgttgagcatcatgctgtattgcacgcctgcgaaaagctggaagaagacggctttgaggtgacatacctcatgcccggcccttcaggacggatcagtgcaaatcaggtgaaagaagcgctccgtgatgatacaatccttgttaccgtcatgtatggcaataacgaagtcggaaccattcagccgattgacgaaatcggagagctgttaagcgggcatcaggcctattttcacacagatgccgtccaggcattcggttatatgccgattgatgtgaaaaaaagcagaattgacatgctgtctgtttccggtcacaagcttaacgggcctaaagggacaggctttttatatgtaaatcaagaggtgaagctgtcaccgattcttcttgggggagagcaggaacgaaagcgccgcgcggggacggaaaatgtaccgggcatcgccggcttaaaagaagcggtcgtcctttcaaaccgtgagagggaagagaaaacagcgaagtataaggagtttaagaacatcatcatgagcacgctggaagaagccggcgttacagcggaggtgaacggagatgccgagaaatgcctgcctcatattttaaacctttactttcccggtgtgccggtggaagcgctgctggtcaatcttgacatggaaggcattgccgtctccagcggatctgcttgtacggcgggatccgttcttccgtcccatgtgcttacggccatgttcggaagtgagagcggcaggctgacttcgtcaatccgcctcagcttcggcctcggcaatacggcggaacaaatcgaaacagccgccgaaaagcttgccgccgtcgttaaacggcttgcttaaaacggcggacttatgtttttaatggagtgaatgcaaatggaaaaacggccggaggatacaagagtcgtagtcggcatgtccggcggcgtggactcttccgtggcggcccttctgctgaaggagcagggctacgatgtaatcggaatctttatgaaaaactgggatgatacggacgaaaacggtttttgcacggcgacggaagattatgaagacgtcatccgggtctgcaaccagatcggaattccgtattatgccgtcaattttgagaagcaatattgggaaaaggtatttcaatatttccttgatgaatataaagccggaagaacccccaatccggatgtcatgtgcaataaagaaattaagtttaaggctttcttggatcatgctctgtcactcggcgcggattatcttgcgacgggccattacgcccgcgtggacagaagcgcagatacagtgcgcatgctccgcggtctggatgaaaacaaggaccagacttattttctgaatcagctcaatcaggaacagctcagtaaagtcatgttcccgatcggtgatctgcaaaaaagccgcgtgcgggaaattgccaaagaagcagaacttgcgacagctgcgaaaaaagacagcacgggaatctgctttatcggcgaacgcaacttcaaaacgtttctcagccaatatctccccgctcagccgggcgatatgatgacaatggacggagaaataaaagggcgtcatgacggtctgatgtattatacaatcggacagcgccacggtcttggaatcggcggaagcggcgagccgtggttcgccgtcggtaaagatcttgaaaaaaacattctgtatgttgatcaaggattccataatccgcttctgtattccgataagatcacggcgacaaatgtcagctggacgcgtcccggtctgatggacggcggcgaaatgacatgcacggcgaaattccgctaccgtcaggaagatcacaaagtaacggtgaaaatgacgggtgatgatgaagcggaaatcatttttgacgggcaggtacgcgccgttacgccgggacaagccgtcgttttttatgacggagaagagtgcctcggcggcggaacgatagatgacgtttataaagacggaacaaaactgtggtacgtataacacatgtaaaaaacctcaactcgcatgttggggttttttagcgaaaggaagttaaaaatggattataataaaatcgggattgacgccatgcaggagggcgattttgaaaaagcggcagaggcttttacgaaagcgattgaggaaaacggccaagacccggtgccgtacatcaacttcgcaaatctgctttcttctgtgaacgaactcgaacgggcgcttgcattctataacagagcgcttgaattggacaattcggcggcagccgcttattacggtgcgggaaacgtatatgtgatgaaagaatcgttttccgaagcgaaggatatgtttgaaaaagcgcttcgctccggaatggaaaacggagatttgttttatatgctggggaccgttctcgttaaattagagcggccgaagcttgcactgccgtatctgcagcgtgccgttgaattaaacgaaaatgacacggaagcgcgcttccagttcggaatgtgtcttgcaaatgaagaaatgctggatgaagctcttgcgcagtttgagacggtgatcgagcaggatccaggccacgcggacgcattttataatgccggggtcgcttacgcgtacaaagaaaatcgtgaaaaggcgcttgagatgctggaaggcgcaatcggcatacagcctgatcatatgcttgcgcttcatgcgaaacagcttatcacccagtcataacaaaaggagggaaggctcgtggatcagctgaacatcgaagaacagccgtatgtaaaaggcgtcattcatacggtcatttatcataatgacaccaacctgtatacagtgctgaaagtcaaggttgcagaaacgtctgaggcgatcgaagacaaggtcgtatccgtaacgggctacttccctctgctgcaagaagatgagacctacacattttacggaaaaactgccacgcatcctaagttcggcctgcaatttcaggctgaacactttaaaaaagaaattccgaccacaaaagaaggaatcattcactatttatcaagtgatctgtttgaaggaatcggaaaaaaaacggcggaagaaatcgtcaaaaagcttggagacggcgcgctcaataaaattctggctgatgcgtcggtgctttatgatgtgccgaaaatgtcaaaaaagaaagcggacaaactggcgggagagctgcagcggcatcaggggcttgaacagattatgatctctctgaaccaatacggtttcgggccccagctatccatgaaaatatatcaggcctacgaaacggaaaccttggagaaaattcaggaaaatccttatcagcttgtaaaagacgttgaaggcatcggctttgtgaaagctgacgagctgggcggaaaaatgggtctgtcaggaaaccacccggagcggatcaaagcggcaatcttatatacgattgaatcgacctgtctttcagagggccatacgtacatagagacaaagcagctgattatcaatacgcaaacgctcctgaatcagtcagctgaaggcggccgcgtcacggaaatggatgcggctgacggcatcatcgccctcggggagagtaaggatatcgtcatcgaaggagagcgctgctattttccctccttgttttacgcggaacaaaacgtcgcaaaacgcgtgctcgacattgcggctcagacggagtatgccgatcaatttcctgaatcggaatttctgcttgcactcggtgaactggaagaacggatgaatgttcaatacgcaccaagccaaaaggatgccattcaaaaagcgctgtcttcaccgatgcttttactgaccgggggacctggaacggggaaaacgaccgttattaaaggaatcgtggaattatacagtgaactgcacggcgtatcccttgaccccggtgattataaaaaagacgaggcgtttccggtgctgcttgccgcgccgaccggaagagccgcaaaacggatgagcgaatctacgggtctgccggctgttacgattcacaggctgctcggctggaatggcgctgaaggctttacctacaacgaagatcagccgattgaagggaaactgatcattatagacgaagcgagtatgcttgatatctggctcgccagccatttgtttaaggcgcttcctaagcacattcagctcattgttgtcggtgatgaagaccagcttccttcagtaggaccggggcaggtgctcagagatcttttggcttctgaagtgctgccgaccgtgcgcctgacagatatttaccgtcaggctgaaggatcatccattgtggaacttgcccatgatatgaaaaaaggactgcttccaaaggggctgaccgcgccgacaaaggaccgctcatttatccgctgtaattcttcacagattaaagaagtcgtggatcaggtcgtctcgaatgcgttaaaaaaggggtatacctccagagatattcaagtgcttgccccgatgtacaggggaaaagcgggaattaacgagctgaatatgcttcttcaggacatcatgaatccgcctaaagaaaaaaggcgggagctgaaattcggagatgtcgtctacaggacgggcgataaaatattgcagcttgtcaaccagccggaaaacaatgtgtttaacggcgatatcggcgaaatcgtgtccattttttatgccaaagaaaatacggaaaaagaagacatggtcgtcgtctcgtttgacggcaacgaaatcacctttacgaaaaaggatttcagccagtttacccacgcttactgctgttccattcataagtcgcaggggagcgaattcccgattgtcgtcctgcctgtcgtcaaaggctactatcgaatgctcaggagaaatctgctttataccgccattacaagagcgaaaaaatttctgattctttgcggagaagaagaagcgcttgaatggggcgtcaaaaacaatgatgccaccgtcagacagacgtcgcttaaaaacaggctcacagagcagactgaagagatggatgcagaactggccgccctgcaaaaagagctgccgttcagtgtatatgatgcgaacatcggaatggaaggcatcacgccttttgactttatggaagaaaaagcgtaaataaaacccggcacatgttcatgcgccgggttttcgcctgtggaagtcatttcaaagtatgctgcctggcttcttggcaaaacctatacgtgttcaacaaaaggtggttgatcacactttgagaacatgccatgcagctgaaggacgaacagtatatgacgaaaacaccgggcgcagtctcgggatgatatcggatgtatgtttctctctggacggccggtttctcggtttcgtgctggagcagaaacgcctgtttcacaaccgtcatctttttttaggggcaagtgatataaaagagatggatcaagaagccgtagctgccggtcatgctcatttgcagcctttgccgaagagctgtttcacctttgaacagattaaaatgcagccggtgaaatcgcctgatggtgaaatgttcggtttgctggaagatgtatacttttgtttggacaggggcataatcgtagcatatgaactctcggacggcttcttttcagatctggctggcagacgccaagtgcgccgcgccgccgatatgcttattgaagcggggaaagaaggcatcgtcctgaacggataagaggtgtagtctgtgcttgtatgtccgaactgcaaaagtaaagatatcggcaaaatcggcgtaaaccaatactattgctggggctgcttcattgagctgacggtggccaaaggcaaaattgcgacacatcaagtagaggaagacggcacgttaagcagtcttgatgatttgttttctgaagacgaacgcagtatcaatttttaaagttgaaaggagatacgcgcgatgggcagaacaatgacctctctgttggctttaggggctggagccgttatgtatcgtatggcttctcagtccgatatgctgaataaaaaaggtatgaaacggatgagaagacgagtcatgaaaatgttttaagcggaaaaaaggatacttctccggaagtatcctttttacgtttgtctcgcttccagccgtctggcagcgagagacaggctgtaattgaccgcgaaatacatcagggccgccagcagaaagatcgggaaaaaataccccccgtcagcgctttgtccgtttaaaatctgcgcgttatgaatcagttcgggcagagcgatgacgaccgcaagtgacgtatcctttaataaggagataaactggctcacaatcggaggaaccatacgcctgagcgcctgcggcatgacgacgagaaaaagagtctgcgtgtacgtcagtcctgaagaacgcgccgcttcaatctgtcctttgtcaacggattgcaaaccgcttctgatgatttctgacagcatggccgattcaaaaatcgtcagcgccgtgatggcggccgcggtaatttccagtttgatcccgatttccggaagggcaaaaaacgtaaagaaaatgattaataacagcggcaggttgcggatggtttccacaatggccgctataatgcccgagacgataggaatgttcgcatagcgcaaagtgccggcggcaagcccgaacataaaactcaggacaatggagatcagcgcaacataaagtgtgaccaaaaagccgtcccataaaaacagcagatggtcaggtgtataggcgccgctaaaatccatgttattcactctccttctctaataactttttccgagacgtctttccaaatagtgaaccccgatgctgagcgggatcgttaatatcaaataaaaaagcgcgacgaaaatatagacatcaaacacgacaagagtgctcgaggacacgagatccgcctgatacatcaaatcgagtcccgccaccactccgagtattgatgagtttttgacaaggttgagaaattggtttccgagcgggggaatgacgatttttacggcctgaggaagaatgatatatctcatcgcctgactgtaggtgaagcctgacgatctggccgcttccatctgccctttggggacagtctgaattccggctctgatggcttctgcgataaaggcggacgtgtaaatcgtaagcgcaatcgttcccgcctgaaagccgtccagtctcagcccggcgttcggaagtccgaaataaaaaacgaatgtgatgaggagaagcgggatgttacggataaattccacatacgcagtgccgatccattgaaggggtttgaaagccgtgattctcatgactgcgatcagaacgcccagcgcaaagctgcctgccagcgcgatgaagctcgcaagcaatgtgtgcaggaaaccgtccatatacatatcgaagttttccgttaaaattgaaaagttcatctatgtcactccttataaaacggggatgagcatgcatgctcatcccgcggtccgtcctattttgccggttcttcttttatccattttttatagattttttcgtacctgccgtcggctttcatttttttcaaagaggcgttgatttctttgacaaggccggattggccttttttgacggcgattccgtaaggttcatcggtaaaggtttcgcccgtcagctgatattgtttattttcatcggccatgccgtataaaatcgcattatcggttgtgagcgcatctccctgtcccgctttaagcgcagtgaacgcttcggcgtaattttcaaattccagcactgaggcgtcaggcgctttttctctgatgttctgtgaggaagtggagccttttaccgccaatacttttgagccttttcccaggtcttcggtgcttttgatgctgcttccttttttgacgagcagggattgcccggcttcaaaataaacatctgagaaatcaacttcttttttccgctcatccgttatcgtcatcgtggcggtgatggcgtcgatatcgccgttttgcagcatcggaatcctcgtttttgacgtcacttctttaaattccgctttcttctcatcccccagaatatcttttgcgagctgttttgagatatcaatatcgaagccttcaatatcaccggagcttgggtttttcagcccgaataacctcgtatcggttttgacgccgaagatgattttgtctctgtctttaatagaggctaacgtgtcttttcccgttccttttgaatccccggacgtttctttccctccgcaggctgccagcataaagacggccagcagtgatatcaatccgaatgacaaccattttgttgcgcgtgacataagcgctcctccgtttcttttcagtgatttaaaatacggcttaagaataaacgcgccctctcttcacgggggctttcgtaaaattcagccggtgcagcttcttctaagatggatccgccgtcgataaacacgatgcggtccgccacttcttttgcgaatcccatttcatgtgtgacgactgccatggtcatgccttcctttgcgagtgttttcatgacatccagcacttccccgatcatttccggatcaagcgcggatgtgggttcatcaaacagcataatttcgggcttcatcgcaagccccctggcgatggcgacacgctgctgctggccgccggaaagctgtgaaggataagcgtccgctttgtccggtataccgacttttttcaaatagtataaggccgtttcctttgcttcttcttttgattgcttgagcactttgatcggtgcgagcatgatgttttgcagaacggttttgtgcgggtacagatgaaaatgctgaaacaccatgccgatattccggcggacctgatttatatccgttttcttgtcacggatggagacgccgtttaccgttaaggcgcctccatcaactgtttccagctgattaatgcagcggagaagcgtgctttttcccgatcctgaaggtccgatgataacgacgacttccccttttttaatgtgcagattaatgtttttcagcacgtggaaatgtccgtagtgcttatttacatcctgaaatgaaatcatggccatcctccttaaaaaaacatgagtcatattgactggacagttttgaaatcctttaacacattacgatggttatacagacttttatgaatattatttagattatttcgtaatttctgataattatttccgtcaagaggtctgcgtcataaggcgtagtttatgaaacgggaataattccggctttctgtcaaaagataaagcaagaggtgaaacgtcatgcttcaaaaaccgctgcagctcttaatgtggacagctgtatgtctgctcgttttgttaacagtgtatgtcttttgcatgctcgatatgttatggtctcccatttggcttgttataaaatctctctttattcctatattcatcgcagtatttattgcttatcttttacttccgattactgaatggcttcatagaaaagggatgcctagaactttaagcctgcttctgatttattgcctgtttttcggcggaatcggctggggggtttataaaggggttcctgttttaattgaacagctgcaggatctgtctgagagcattcccggtcttgccgaaaactacaacagcatgctgaggcatctgcataatcacacggatcattggcctgacggcatgcaccatcggatggacaaaatgattcagcagacagaaacgtttcttgccggcacgattgaaagcacgatcagaagcatccgtttcgtgcttgattatatcctgatcgcggcgacgattccttttctcgtgttctatatggtgaaggatataggcgtcatgaaaaagacggtctggtatttgacgccgaagtcctggagaaaaagggggagtgaatttctgcgggatgtggacgactctctcggtgattacatccgcggtcagcttctcgtttgttttttgctcgggttaatagccggcgtttcattttggctcttcgggcttccttacccgctgattttgggccttgccatcgggattacgaatgtcatcccgtatttcggcccgtttatcggcgctgtgccggcgctgctcctttcgctggcgatttcctccaaggctgtgatcatcgtaatcgtcacgatttttattcttcaatttatagaaggaaacattttgagcccgctcattgtcgggcgaagtctcagaatgcaccccgtcgtgatcatgcttgcgcttcttgccggaggagagctcgcgggcattcccggcatgattctcgctgttccggcggcagccgttttaaaagtgacggccattcactttttgcggatcaggacggaacattgacattcgggttctgcttgtctataatttcgagtagaatacatacgaatctcgagtgacggataagagtacgccgaagccctgtttaagagagaagctccgatacgctgagaggagcttcagcagaagatcggccgaagctaatcctgagtgcagttaaaggctgccgcaatcctgcgttacgggatgaaaggtgacaggcctttttcggcctgtaatcagggtggtaccgcgagacagctctcgtccctgtgtgaacgcatggtttgcatagggagagagcttttttgctgtcgcaaaagagaatttcgggtagtgataaggaggaatatagatgaaacacttaacttctgctgaagtacgtcaaatgtttttagatttctttaaagaaaaaggtcatgccgttgaaccgagcgcctcattggttccgcatgaagatccgtctttactgtggatcaacagcggcgttgcgacgctgaaaaagtactttgacggccgcgttgtgccggagaatccgagaattgtaaacgcgcaaaaatcaatccgcacaaatgatattgaaaatgtggggaaaacggcgcgccaccacacgttctttgagatgctcggaaacttttccatcggtgattattttaaagaagaagccatcacgtgggcatgggagtttttaacgagcgaaaagtggatcggctttgatccggagctgctgtctgtaacggttcaccctgaggatgaagaagcttatacgctatgggcggaaaaaatcggcgttccggaagaaagaatcatccgtctggaagggaacttctgggatatcggcgaaggcccgagcggaccgaatacggaaattttctatgaccgcggcgagaaatacggtaatgacccgtcagattctgaattgtatccgggcggcgaaaatgaccgctatcttgaagtatggaacctggtattctcagagttcaaccacaacccggacggcacgtacacaccgcttccgaagaaaaacattgatacgggcatggggcttgaacggatggtctccgtgattcaggatgtcccgacaaactttgacactgatttgtttatgccgattattgaagcaacagagcgcatttccggagatgcttacggaaaggacgcaatgaaggatacggcctttaaagtgatcgccgatcatatcagaacggtcgcatttgcggtaagcgacggagctctgccgtcaaatgaagggcgcgggtatgtactgagacgcctcttgcgcagggcagtgcgatacgcgaaaaccatcggtatcagccgtccgtttatgtacgagctggtaccgactgttgcaggaattatggacgctttctatccggaggtgaaagaaaagcaagagtttatcgccaaagtcatcaaaacggaggaagagcgcttccacgaaacattaaacgaaggtctggccattttatctgacgtgataaagaaagagaaggaaaaaggcagcggcatcatctccggaaaagacgtattcaaactgtacgatacgtacggattcccggttgaattgacggaggaatacgcggaagatgagcaaatgaaggttgaccataaaggctttgaagccgaaatggaaaaacagcgtgaacgggcgagaaatgcgcgccaagatgtaggaagcatgcaggtgcagggcggcgcattgcgcgacattaccgcagaaagcacatttgtcggctacagtgccgtaaaagctgaagcgaaggtgatcgagcttcttcatgacgggcaattaatcagcgaggcgcatgaaggggataccgtccaaattcttcttgacaaaacgcctttctatgctgaaagcggcggacagatcggtgacagaggagtgctgagaagcgagcaggctgtcgtaaccattaaagacgtgaaaaaagctccgaacggccagcatgtacacgaaggcacggtggatagcggcacgattcaaaaaggcgcaagcgtgacggctgaagttgaagatcaaatgagaagcggtgtggtgaaaaaccatacagcaacccaccttctgcaccaggcgctgaaagacgttctcggcacacatgtcaaccaagcgggttcactcgttaccgaaaatcgtctgcgttttgacttctctcatttcggtcaagtgacgaaagaagaacttgaacgcattgaaggaatcgtcaacgaaaaaatctgggagagcattccggtagcgattgatttgaaaccgatcaatgaagcgaaagaaatgggcgcgatggccctgttcggcgagaaatacggcgatatcgtccgcgtcgtacaagtcggagattacagccttgagctttgcggcggatgccatgtcacgaatacggctgaaatcggtctgtttaaaatcgtatccgaatcagggatcggcgcaggtacgcgaagaatcgaagccgtaacaggaaaaggcgcttatcaggaaatgaacagccagctcagccttctgcagcacgctgcggatgagctgaaatcaaacgtaaaagacgtaccgaagcgaattcagtctcttcaagcggagctgaaggaagcgcaaagagaaaatgaatcattgctcagcaaacttggcaatgtggaagccggagccattctgtcaaaagtaaaagacatcggcggcgtaaaagtgctggctgaaaaagtaaatgcgaaagacatgaaccaccttcgtactatggtggatgatctgaaagcgaagctcggttctgcggtcatcattctcggcgccgtgcaaaacgagaaagtcaacctttcagcaggcgtgacgaaagacctgattgaaaaaggccttcacgccggcaaaatggtcaaacaagcggctgaagtctgcggaggcggaggcggaggccgtccggacatggcgcaggccggcggaaagcagcctgaaaaattggaagaggcgctcgcatctgcggaagattggataaaatccgttttataatcctttcaactagtgtagaatgatgataagatgaggacctcaggctgaactttgcctgcgaatttgggaaagaggtgcaaaacggtgagctcgtttgataaaacgatgaaatttaatttctccgatgattctgctgaaacaaacgtcgaagaagtgctgattacggtatatgatgcgcttcaggaaaaggggtacaatcctatcaaccagattgtcggatacttgctgtctggagatcctgcatacattcctaggcatcgcgacgcccggaacttaattcgcaaactggaacgtgacgaattaatcgaggaattggtaaaatcctatctagaacagcataaagaggcgtaaatacattcatgagaatattgggacttgatcttggaacgaaaacactcggcgtagctttaagcgatgaaatgggctggaccgctcagggcattgagacgataaaaataaacgaggctgaaggagattacggtctggaccgtttatccgagctgatgaaagactataatgtagagaagatcgtgctcggttttccgaaaaacatgaacgggacgatcggtccgagaggcgaagccagccaaacatttgcgaaactgcttgaaacagcgtacaatgtccctgttgtgctgtgggacgagcgtctgacgacgatggcggctgaaaaaatgctgatcgcggctgacgtcagcaggcaaaaacgaaaaaaagtcattgataaaatggcggctgtcatgatccttcaaggatatctggacagtttaaactaagaggtgaaagaaatggaacacggcgaaaaacatattacaattgtcgatgatcaaggcaacgaacagctttgcgaagtgctgttcacatttgaaaacgacacattcaacaaatcttacgtactttattatccgattgatgctcaagacgatgatgaaattgaaattcacgcttcaagcttcgaaccgaacgaaaacggtgaagacggcgaactgatgccgattgaaaccgatgaagagtgggaaatgatcgaagaaacgctgaacacgtttttagcggaagaagacgaagaataaaatgaacggaaaaagccggagcgcatatgcgcttcggcttttttttgtaataaattgccgaatgcacatgaatcatgtagtataagagctgttgggaggaaaatacttgtatgaatatcaatcagactaaaaattcatttccgcgtaaaaacaaaaaaacaacgataatactgtcctccgtgatcgctctgcttatcatcatttgcggtgcttttttctatggaaaatctctgctgtccccggttgacaaaggcagcaaaacggcagtcaatattaatattccgagcggttcttccgtttcggcaatcgctgaaattcttgaggatcagcatgtcatcaaaagcaaaaaagcatttcagctgtatgtgaagtataaaggcgcttccgggtttcaggcgggattttaccacctgaataaaggaatggatgcggatgcgattatcaaaaaactgaccgcgggatcaacgggatatgcctttcagatctccgttcctgaaggaaaacagcttacacagattgcggatgcgatcgcaaaagaaacatcatattcaaaagaagagatcatggcaaaactggatgacaaaacattcatcggcaaactgaaaaaacagtttcctgatacaataacggacgcactttcaaacaagaagctcaagcatccgctcgaaggctatctgtatccggccacatatccgtttaatgatccggatgcatcgcttgacacgattttgacggcaatggttcaggaaacaaatacccgtatcgaaacgtataaatctgaactggaaaaaaagaaactttccgtccataacgcgctgacgatggcatcgcttattgaagaagaagccaccgccaaagccgaccgtcacaaaatcgccagcgttttttacaacaggcttgcagaaaaaatgccgctgcagactgacccgacggtattatatgcggccggtaagcataaaagccgggtctactacaaagacctgaaaattgattctccgtttaatacgtataaacataaggggctgccgccgggaccgattgcaaatgccggtgattcatcatgggaagcggctctccgccctgacaaaacggattatctctatttccttgcaaaaccaaacggcgaggtcgttttcaccaaaacattaaaagaccataataaagcgaaggaaaagtatatttccaaaaaagacagcgaataaaaggagggcaaaagctctccttttattccattctgaaaggttttatgataaaatatatcgggttgtttacttatggataaagaagtgtcttaagagagtgtccccgcggattcgtcaggggcactcctttttagaacggaggctgtttgccgtgaatgatcggtatgaacaaataaacgagtatataaacgcgatgctgaagcctcggcctgataaagtgaaaaagcttgaagcctatgcaaaagagcaccatgttccgattatggaagaagcgggcattgaagtgctgcttcaaatgctgtcgattcaacaggcgaaaaacattttggaaatcggcgcggcaatcggatattccgccatacggatggcgcttgagcttccggatgcgaatatttacacgattgaacgggacgacaaacgctatgaagaagctgtgaacaatataaaagactttgaaatggaaaaccgggttcacgtaatgcacggggatgcgctggaactttctgagtctgtccgtgtcacggctccttatgatgccatttttatcgacgcggccaaaggccagtacacgaacttttttgagctctatgaaccgatgcttgcgccggatggagtcatttttacagacaatgttctgtttaaaggactggtggcacaaaatcactcggacattgagccgaaaagaagacggaagcttgttgaaaaaattgatcaatataaccaatggctgatgaaccggcctgactatcaaacggtcatactgccggtcggagacggcatcgccatcagtaaaaagaagaggtgaatgatcatgaaaaaacctgaacttttggtgactccgacttctgtacaggatattcttccgctcattcaagcgggcgcaacggccctgttagtcggagaacagagatacggcctgagactggccggtgaattttcaagagaagatataaaagaagccgtaaagacagctcatcaggaaggcgcgaaagtgtacgccgccgtcaatgctatttttcacaacgaaaaagtggacgagctgaacggctatcttgcctttttgcaggaggccggcgttgatgcggctgttttcggtgatccggccgttttaatggcggcgcgtgaagcggctcccgatcttaaactgcactggagcacggaaacaacgggtaccaactactattcctgcaattactggggacgcaaaggcgcacggcgggcagtgctggctaaggaattaaatatggacagcatcattgacataaaagaaaacgccgaagttgaaattgaaattcaaatccacggcatgacgtgcatgttccaatcaaagcgttctttagtgggccattacttcgaataccagggaaaagtcatggacatcgaacagaagaaaaaagaagcgggaatgtttctgcatgacaaggaacggggcaataaatacccgatttttgaagatgaaaacggcacgcacatcatgagcccgaacgatgtgtgcatgattgatgaattagaggacctgatggacgccggcatcgattctttcaaaatcgacggagttttgaagtctcctgaatacttaactgaagtgacccgcatgtacagagaagcaatcgatctgtgcttcgaaagccgagagacatacgaagagaaaaaagagagctggatagagcggattgaaagcattcagcctgtgaacagaagcatcgacacaggattcttctttaaagaaacggtctattaaaaaggagggtgcaacggatgacagccgtaaatcaaaccatttccaaagtcgtaaacggaaaacgcgtcattacgaaaaaacctgaactccttgctccggcaggaaaccttgaaaaattaaaaattgccgttcattacggagcggacgcggtttttatcggaggacaggaatacggactccgctcaaatgcggataacttctcaatagaagaaattgcagagggcgtagaatttgccaaaaaatacggggcaaaaatatatgtgacaacaaacattttcgcccataatgaaaatatggacggtctggaagaatacttaaaagcgttgggagacgcaaaagttgccggaattatcgtcgctgatccgctgattattgaaacatgccggagagtggccccggacgtagaaattcacctcagcacacagcagtccctttccaactggaaagcggtgcagttctggaaagaagaagggcttgaccgcgtggtgcttgcccgtgaaacgagcggactggaaattaaagaaatgaaggaaaaggtggacattgaaatcgaaacctttatccacggcgccatgtgtatcgcttattcaggacgatgcgtgctgagcaatcacatgacagcccgggattccaaccgcggcggctgctgtcagtcctgccgctgggattatgacctgtatcagacagacggtgcaaacgcggtcgcgctttatgacgaagaagacgctccgtttgcgatgagcccgaaagatttaaaattgattgaatccattccgcaaatgattgagatgggtatcgacagcctgaaaattgaaggccggatgaaatcgattcattacgttgcgacggttgtcagcgtgtatcgcaaagtcatcgacgcatactgcgctgatcctgaaaactttgtcattcaaaaagaatggctggatgagctggacaaatgtgcaaaccgggataccgcgcctgctttctttgaaggcacgcccgggtatgaagagcagatgttcggcgaacacggaaagaaaacaacatttgattttgccggtctcgtgctcgcgtatgacgaggaaactcaaatggtgacgctccagcagcgcaatttctttaaacaaggtgacgaagtggaatttttcggtcctgaaatcgacaatttcacattcacaatcggcactatttgggacgaagacggaaacgagcttgatgctgcccgccatcccctgcaaatcgttagatttaaagtagacaaaaagatttatccgagcaacatgatgagaaaggggaagtaatcaccaatgggtaagagtcctgtagttataggcatcgcaggaggttccggatcaggaaaaacaagcgtcacccgttccatctatgaacagtttaaaggacactcgattttaatgatccagcaagacctttattataaagaccaaagccatcttccgtttgaagaaaggctgaacacaaactatgatcacccgctcgcatttgataatgactatttaatcgagcatattcaagagcttttgaattaccggccgatagaaaagccgatttatgattataaactgcatacgcgttctgaggaaaccattccggttgagccgaaggatgtcattattctggaaggcattctcgttctcgaagataaaagacttcgcgacctcatggatatgaaactttatgtcgacacggacgcggatctccgtatcatcagacggattatgagagatattaacgaaagaggccgttcaatcgattctgtcattgagcagtatgtgtccgtcgtcagaccgatgcacaatcagtttgttgaaccgacgaaacgctacgcggacatcattattccggaaggcggacaaaaccacgtcgcaattgatctgatggtcacgaagattcaaacgatccttgaacaaaatgcaattttgtaataccatagcatagacataaataactcagaccatattatgtataggctggaagggaatgagacagttcccttctttccctgtttataaaccgaaacatttgcagaaaacacacattcagtttaagataaacagtacctatatgggagagaagaacgaggactgccctgtgttctcattcttgattttttcgtttatgctctcatacataatcacacgttattgttgagggacaaccaccaaggagtgaaggaacatggcacaagaaaaagtttttccgatgactcacgaaggaaaacaaaaacttgaacaagaattagagcaattgaaaacggttaaacgtaaagaagtagtagagcgcattaaaatcgcaagaagcttcggagatctgtcagagaactctgagtatgattccgcaaaagaagaacaggcatttgtggaagggcgcatcacgacgcttgaaaacatgatccgcaatgcgaaaatcatcgaggacgacggcggttcaaatgtagtcggtttgggaaaaaccgtatcattcatcgaattgcccgacggtgaagaagaatcttacacgattgtcggaagcgctgaagctgatccgtttgaaggaaaaatctcaaacgactcgccaatcgcaaaaagcctgctcggcagaaaagtggacgaagaagtgacagttcagacgccgggcggagaaatgctcgtgaaaattgtgaaaatttcataagatccgtttaacaatgaaacacctcgtccaaaatgtggatgaggtgttttttatgatcgtatcaaaaaggctgaaaacggccgtgatttgttttctgctcgtgtttttctttctgcttgcaaggctggctgaaattcagctgttttttacagaatctttttcaaaatccaatattaatctgattcaggaaagcgtcaagcagcggacggaagaagtccttatttcagacggccgcggctcttttcttgatcggaacggcaaagaactgaccggaaaaaagcagcctgccgtcatactgtttccctttctcgtgacgcaggattggccggttgaccgggtatcagacattctcggaatgaaacagggggagctcaggcagctgctgacggaagcaaaaaaaccggtgatcctgaacagcagaaaaataaaacatttgacgaaacaatccgtggcaaatatcaattctttgaaatatcccggcatttacggcgtatatatgaaagacagcaaagaaacaaacatagccgctcatctgttgggcgcgacaaaccaggaccctgagcttttgaaaaagaaataccccggcaggaaggaactgccgatcacggcaaaaatcgggacaagcgggatggagcggacatttgatgagtttttactggcggatcaggacacaaaacttttgtatcatgtcgacggaaggggaaaccctttattcggaatggacgtcaaatatacggctgaagcaaacgcgttttatccgctgcaagtcaaaacctccatcgaccgcaatattcaaaaagcaatggaagatgtattgaaagaccgcgggttaaaaaaggggggagccgtccttttagacattgaaaaaagcagtgtgctcggaatggtatcaaagcctgacgccgacatgtcaaagcagcagacactgcaaaattacatgctgacgccgatttatccgggatcagtgtttaaaacggtgatcgccgcagccgcaatagaacaaaacgaagtgaagccgggcacatcctttaactgcaatctcaacctgtacggagagccgggggatgataaaggcacgctcagttttggagaaagctttgcccaaagctgcaattatacgtttacaagtcttgcggaaaaattaatcaaaaaagatgattccgttattgaaaacatggcggagaaactaggtctcacacagcgggcgggctgggaaggcaagctgtaccgggaagacggattcagacagctgtataatgaaaaaagcggggtcatttggggagatgacaaagacaaaaccgtaaaaaaagccgtcgcacagacggcgatcgggcaaaaaaacgtgaaagtcacgcctcttgaagtcgccaatatgatggcggcgatcgcgcgcggcggtgagaaaaaacaagtcaaaatcgcggacaaaattgaatacaaaaacaaaacgacgatggcgtcattcaaagaacagccgttaaaaggggaaaacatcgacaaatatacggcgcagcagcttcaaaaaattctcagagaagtcgtcacctcaccgaaaggaaccggccgaaggtttcaggatctgccgtatgagatagcaggcaaatcgggaactgcccagacgggaatgttcacaaaagaaaaacagacgctttaccacaaatggtttgcgggatactttcccgcggacaagccgaaatacgctctcgtggtgctgcacatggacacgccgggggataaggctctgacaaatacagtgttttatgatattgttaaaaaggtacatgaaaatgaaacaaatcagacatagaacaaccgctcagcccatgttaaaatatatgctgagcaagagggataaaggagtgcagaatgattgagcaataaacaatctcgttttgaaaaccgtgataagcgcagaaaagcaaatatggtgcttaacattttaattgctatcgtatctattcttattgtcgtcgttgcagtcagcctcttcatcaacagtccgtcgagcgacgtgagcgaaaaagcggacacgagccagaagcaggaaacacctgcatcaggcaagacgaagcagacatccgatgaagacataaaagacagcaaaaaagatacggcatcagacgatgacaaaaaagataaacaggataaggacacatctgattcatcttcagactctgacagcaaaaaagacgatgattcatcgaaaagtgatgacagcagcaaaaaagactctgattcaagcgatccttttaaaggcgcaaaaataacagagggcggctcatcaagcgatgttgagaaaacaattgttaacccaaaatggaaagcggtcggaacaaagcagacgggagaacatgcggcgacgtatgactcaagctctgaagactggtccgaaatgcttgacgccatctcttacgcaacaggcgtgtcaaaagatcacatgacagtgctgtggctcggaaacaatggaagcccgcaagatgcgaagggtaaagttttagacaaaacgaacggcaaaaagtatcaggtcaccatcacttggaaagacaaaaaaggctggaagccgacaaaagtagaaacgttaaaataaccgcaaaaaagcagctgattattcagctgcttttttctgtcatacgtcagctgaaaaatgcaccgacgcgctgtaaaggattctgccgtcaacggccgtcacctgatgggatacagaacggacgcgaagcataatcgcctggttgttttcaatctgaacgtttattttcttttcaagctcctgcaaagatgccgcttcgaaaaattctactttatctttgattaaatccaattgaaaattcatcagtacagatcctcctgatttttcttctgagtcaatgaaagtataagcctttctgccgtaattgcgcaataatcccaaagtattttagtacccttccattcttttttgtgataggataggaactgttccacgattaatccatactatactcataggaattataaattatggagagtgaaaaatatgggccgtgaatttattccattatttgaagattgggcagcgacttatgatgccacagtgcacggggcagacaaacaatacgctgatgtttttaaagggtatgacaatattcttgacagcatcgtcgcactttcgggttctaacgttttagagttcggaccgggcacagggaatttaacggcgaaattagccgccgcgaacaaaaaggtgtttggtgtagaaccgtctccgtcaatgagaaaactggcggctgacaagctttctgacaaagccgtgttcagtgacggagattttctggagtttcccgctccgccttttcaaatagataccatcgtcagctcgtacgcctttcatcatttaaccgatgaagaaaagcaagcggctgtaaagcaatatggcacaatccttcagaagcatgataaaatagtgtttgccgataccgtctttaaagatcatgaagcttatgatgaaacaattaaaaaagcaatccgaaacggctatcatcaattagcggacgatttaaagacggaacattatccgacactcgggacaatgaaaaacatcttttcagaagagggatttgccgcgcggtttacgcagcaaaatgactttgtctggataatggaggcgattaaacggtaaatcgaagggattgtgtataaatgaaactggcagtcatcggagcaatggaagaggaagttacgattttaagaagcaaactgaaagacgcaaaacaagagatgatcgctcactgtgagtttacgacgggcagctatgaaggcgtcgaagttatcttgctgaaatcggggatcggaaaagtcaacgccgcgatcagcacgacgcttctgcttgaccgtttcaaacctgattatgtgattaacacaggctcagcgggcggttttcatcatacattgaatgtaggcgacgtcgtcatctcaacagatgtccgccatcatgacgtggatgtgacggcgtttgactatgaatacggacaggtgccgggtcttccggcagcatacaaagctgatgaaaagctgatcagtattactgaggaagcggtttctgaactgaacggcattcaagtcgccaaaggcacaatcgctacgggagattcttttatgaatgatccgaagcgggttgaagacgtacgcgccaaatttgcggatttgtacgcggttgaaatggaagctgcggctgtcgcacaggtgtgccaccagttcaaaacgccttttgttgtcatcagagctttatctgatattgccggaaaagaatctgacgtttcatttgataaatttttagaacaggctgccgttcattcaactgagcttgtcctgaatgtcatcaaacgaattcactaagcgggggattctcgttctcctccgcttttccaggaggaggacatatattgaacgtgataacagatattacagaactgatcggaaatacaccgctgctccgtctcaagcattttgatataccggagggaacagcggtttatgctaaacttgagatgatgaatccgggcggaagcattaaagacaggctgggcggaatgctcattgaagatgcgctacgcacgggaaaggtgaaaccgggcggtgttatcatcgaagcgactgccggaaacaccgggatcggactcgctctgtgcgccagaaagcatcagcttcgcgccgttttttgcgtcccggagcatttcagcagagaaaagcagcaaattatgaaagctctcggagcggacatcgtgcatacgccgagagaagaaggtatgcagggagccattcgaaaagcgcttgaactggagagagagattaataattcttatgccgttctgcaatttaaaaaccgagtaaatccattgacttactataaaacgatcggacctgaaatatggaacgcgctcggcggggatatccacacctttgtcgcaggagcgggttccggcggcacctttgccggtacggcagcttatttaaaggagaaaaatcctgccgtcaaaacggtgatcgttgaaccggaaggctcgatcctgaacggaggagagccgcatgcccataaaacggaaggcatcggcatggagtttatccctgattatatggacgagaaccattttgacgccatttacacagtggaagacgatacggcgttttcgcttgtcagagaagcggccgagaaagaaggcctcttaatcggaagctcttcaggggcggctctttatgcagcgcttgaagaagcgaaaaaagcgcccgccggatcaaatatcgtcactattttccctgacggcagcgatcgatatataagcaaaaacatttttcaaggaggtcagtaagatgaagaaaaaaacgctgatggtgcacggaggaattacgggagatgaaaaaacaggagcggtttccgtaccgatttatcaagtaagcacgtaccggcagccgaaagcgggcgagcatacgggttatgaatattcaagaacggccaatccgacgcggacggcgcttgaaagcttaattgcggagcttgaaggcggcgcggcgggatatgcgttcggctcaggcatggctgcgattactgccgtcatgatgctgtttgacagcggcgatcatgttattttgacggatgatgtatacggcggcacttaccgggtgatgacaggtgtgctgaaccgcttcggtattgaagcggactttgttgatacgagcagtgaagaaaaagtcaaaaaggccattcgcccgaatacgaaagccatttatatcgaaacaccgacaaacccgctattgaaagtgactgacctcaaactgatgtctgacatcgcaaaagaagcgggcgtattgcttatcgtcgataatacattttacacgccgtatttccagcagccgctcagctttggcgcggacatcgtgctgcacagcgcgacaaaatatctcggcggccacagcgatgtcgtcggcggcttagttgtgacggctgataaagagctcggtgaaaagcttcattacgtgcaaaactcaacgggcggcgttttaggaccgcaggattcatggcttttaatgagaggcattaaaacactgggactcagaatggatgccatcaatcacagcgccgggaaaatcgccgagctgcttgaagcgcatgatgccgttcagacgctctactatccgggatcagcgaaacatccgggccatgagctgacaaaagcgcaaagctccggtttcggcggaatgatttcctttgatatcggcagcagtgaacgcgtcgacgcgtttttagaaaaattgaacctgtttacaatcgctgaaagcttaggagcggttgaaagcttaatctccgtgccgtccagaatgacgcacgcttcgattccgcgcgaccgccggcttgcgcttggcattaccgacgggcttgtacggatctcagtcggtattgaggatactgaggatttaacggcggatgtgaaacaggcgcttgattcccttttataaagaatggatagatttacattctctgtcggctgtcagcttgtattataatgttggtagactataaaactggcaggtgaccttatatggagaagaaaagactgaaatcattaatagaagattttaagcattacgcatttattctgcttgcagtcagcaccttcatttatatcggcgcggttcttcccggacaagggctgactgcgggccagaaaatgctgatgtttgtaacggattgtgcatttttagcgggcgcttatttctgcgttgaccgttcacttatttataaaaagaggctggaagaggccgaagaataaaaaaagccattgtcttttgacaatggctttttcatttcttattcagaaggggtttcgcgtaattcttttcccattccttttaaaaactgcagcccgaagccgagcgcgcggttaatatcaggatcaccgacggctttcatcagttcaaacatactgactttcctgtcctcttttaaaaatctttgcgcctggtccgtcccggccatggcgctttctaaaagtctgcccataaattcgggatcagcttttgacagcgcgcctcccgcggccatcatcgtattcaggagattggtgacaggttcccgggaaatctgtccgagtgcgattttggcaatctcctcttttgcctggagcatatagccggcggcatcaaaaatgcccaagccattcagctctgccataatggacatcgttttcgcgacggcttcttcattttctgcgagaagcgtcttcagttcttccagtttttcagctttcagctgttcctctgttttcgtttctttttgaatttcagtaattgggcttgccattatgtttcctcctttccttaatcagttaggtgcacatagcccggacggttccattttcgctgagcttccacaccgttttgcggatgacgttttttgttccgcggattcgttttcggaagcggcggtgtatcacaggaaccgagcacttccatgcggacttttgtctgtttataggcaggtgtatgtgtccgtgaatcatacgcaggcccggtcaggaaattaatcgcagaatctttatctgtagagttcatcggcagataaagctcatttgcgcggacacggtctgtcacaagcgcattcaatttaaccgccccaaaaggagagacgagccggatcattgttccgtcgcaaattccgcgttcagccgcgagctccggcgatacttcaacaaatacatccggaactttagactgaatgccttttgacttgtttgtcatgtttccttcgtggaaatgttcaagcatccgtccgttgttaatatgcaggtcatattcttcagggaatacggcaggctccacccaatcgctcagcgcaaaacgggcttttttgtccgggaagttaaagccgtcttcataaagaagcggagtgctctctcccgtaaagcttccccacaggaagctgttccagccgctaagaacgtcgtagcttgcttttccgaacagcggagaaaggctcgccatttctgagaaaatgtcgcttggatgcgtgtaattccaatcagcgcctaaacgattggcaacctcctgaataatccaccagtcgggtttggcatcgccgagtgtcggaagcgcctgatacaatctttgtacacgacgctctgtgtttgtaaatgttccgtctttttcaagagatggaaccgcaggcaggatgacatccgcgtattgcgccgttcttgaaaggaaaatatcctgtacaacaaagaaatcaaggctggataaaatgtcatgaacatggttggcgtttgaatcgacgagcgccatatcttcaccgacgagatacatggctttcatgtttccttcttcaatcgcatggagcatttcaatattatcaagacccggcttgccgtcaatttcaacaccgtaagctttttcgaatttagcgcgtgccgcatcatcggtaatatgctgataccccggaagccagcctggaagagttcccatatcgcaagcgccttgaacgttgttatgtccccgcagcggataagctccggcgcccggacggcggtagtttcctgtggcaagcagcaggttggaaatcgccgctgatgtatcagagccgcctgtattctgggtaacgcccatgccccaaagaacacaagtgccgtctgcatcacgaatcatttcggcaatgcggatgatcgtatcctgagaaagtccggtgatgcgctccgcatattctaatgtatactttttcagcgtttctttataatcttcaaagtagttgacattctcatcaataaacgcttgatcgtgccagccttggtcaatcatatattttgtcactgccatgagccagacttggtcagtcccttgtttcgggctgataaagaggtcggaccgttcagccatttcatttctgcgcagatcggcaacaattaatttttgtccgtgcagcttatgtgcacgtttcacgcgtgtggccagaaccggatgtccttctgccggattggcgccgacgatgagcacgaggcccgcttttgcgatatctttaattgtgccggcgtcaccgcccataccgactgtgcggaataagccgtccgttgccggtgactggcagtagcgtgaacagttatccacgttgttggtttcaaatacttgacgcgctaatttttgaataacgtagttgtcttcattcgtaattttagaagaagaaataaaaccgacagaaccatttccgtgttcggccttgatcgaaccgagtcttgaagcgacaagatcaagagcttcttcccatgacgattcaacaaatgcgccgtttttccggataagcggttttgtaatccgttcttccgaatttacgaagtcccagccgaatttccctttcacacaagtggaaatcgcattaaccggagcatcggaaacaggctgaattttaaggatgtcacggccttttgtccatacttcaaaagagcatccgacgccgcagaacgtgcagactgtttttgtttttttcgtccgtttatcgcgcatagccgcttccacttctgacacggcgaagatgcttgtatagtcgggttcaacatttttcactaaatcaatcatcggttccatgacatcttcttttattcctgtcataaatccggcttggccgagcattgatttttccatcagtgcgttacaagggcagacagtgacacattggccgcagctgacgcaggatgattcattaatggggacgccttcatcccaaatgacccgcgggcggtcgcgctcccaatcaattgaaagggtctcattcacctgaaggttttgacacacttccacacattggccgcaggcaatgcattggttcggatcatagcggtaaaacgggtgagacatatcaaccgcgcactttgaatcatctttcggcgtatacggatatttctgatgctcaattcccatcatttccgctgtattatgcagtgtgcagttgccgttgttgttatcgcataccgtacagtaaagcaggtgattctcgagcaggcggtccatggcctctgtctgagcctcttttacccttcccgacgtaagcgagatggacatcccgttttctgcagccgtggaacaagagcgctgcaatttcccgtttacttcaacaatacaggtgtcacatgtttgaatcggatctacttccggtacatggcatatttgcggaatctcaattccgttttggtttaaaatatctaaaatcttagacccctctggtgcttcatactccgtgccgtcaattttgacacggatagactgaacgtctgtcacttccaattcccctccatcttttaaactcgaaaaaaagccatgcacatagataccggcctcctgtccggagaacggtataaatacgcatggcggaatagttcactagcaagtcttactaacagaccaatcctatttgtataaaacgatagactcataacacgtttcctattacaaatccatcttcactgcttttattataaggtgatatttattataatacaatacgaaaggaaaactttaaccaggtgaaatgtcacaaaggggaaccgggaatgtctttcataggctaaaatcggaggggacaatatgtctaaaaaaattcatgaatttaacgatattatccggaaattgcgcaaagaattatttggaaaggggccggaacgaattcacaccgtttttgtggataacatggcggtatcaacgctttacggcaatctaagcgcaagtgagcagtttatcgcacgcacgcctgaaggaagagaaatggttcatgcggcgcggaccagcttaattcaggaactgtattcaaaacaaacgcctgacggaatggaagagctcatcggagcaaagctcgtgcatctgttttcagacatcaagatcgaagagaatattgcggtgtctgtatttgtctttgaccgaacaattgaagagcgccgtgaagaaatcaaaagctgaaaaaaattcaattgacacgaaattgtcacatttgatatgatatgaactgcctgcagtggcttaaggacgaattttatggaatgtgtgcatgatctgtacattttctatagctgatattttcattctgcttgatattgttgtatgggtatgcatacaagttaggcagcattcaaacccgttttagacgggctgtttgaatgctgccttttttgttaggcgtctttggaaactgcggggctgaaatgataaatggaggggttattatggcttttcgtaaaccggacgaaatagcggagcttgcggtcgaatcaggggtaaaaaaggtgcattcaccgctttcagcactgattgtattaggatttttgggaggagcgtttatcgcactcggttatttgcttgatatccgtgtcatcggcgaccttccgaaagaatggggaagcttgtcgagtttaatcggggcgtccgtgtttcccatcggattggtgctcgtcgttcttgccggcgcggagctgattacgggtaatatgatgtcggtatctatggcgcttttttccagaagaatatccgccggtgcattagtgaaaaattgggtgatcgtgacgttgatgaatcttgtcggcgcactgtttgtcgcttactttttcggacatgttgtcggattaaccgaaacaggaccttacttggaaaaaacgattgcggtcgcacaaggcaaattggatatgccgtttggaaaagttattgtttcggcgatcggctgtaactggcttgtctgtttggccgtctggctttctttcggcgcagaagacggagccggaaaaatcgcgggtatatggtttccgattatggcgtttgtcgcgattggttttcagcacgttgtagccaatatgtttatcatcccggctgcgatttttgcaggttctttttcgtggggtgatctgattggcaatctcattccggcctttatcgggaatgtaatcggcggggcagtgtttgtcggccttatttattttattgcatattcaaaaaaagatcagaaaaagcaagggatgaaaagagtttcctgaggtaagaaagatgccggaaaacaaggacaattgaagcggaatgccagcacattttccgtccaaatcttgaaaaaaatgtttacaaaatggaagctgatggatatacttacaaagtaagaaaaaagcaaagggaggttgaatcacatgacgactttaaacggcaatcaaaatttacaattgaaccgattcagcctgtggaagagttcgtgtccttccttaacctctgcccgtcaagcacgttaatttcggagtatcaggacattcgcagctccccgcagggaaagaagcacgtcttcttttgtctgcggatttagtctgcccgcagcgcatatgaagtttgctgcgggttattttcgcttgtgcggatattgaaagggggtgagcgataatgaccattaatcttttctttttaacactgaccatttcaaagcgttttaaaagtgcggaagagtatgaacgagaacagcaggtcgaagagttttataatgaagcgaaagaacgccagctgaaacacttttatatgaactgaacggacacgaagggccaaaacggaggagaaggaggagatcatcatgttcagaattgaactgctgaatcattacacaatggagaaggaccaggtttagcgaggatgttgctgtcacgtcgcagacggcctgcataccatggtaaagaaagaaaaattggtaagcgggtgatagcatgcaaggcggtcagaacagaattccatccatcgggcacgggtatgcgtcaatgccccattcatttaaacacggctacggcaacccgtatcgccggcagagaatggcggcgctttcccggcagacaagatatatagcaccgtattattggtactagagcaggcggaaaacctacgttttccgtcttttttttatgaaaacaaatataaatttcaaataaatcgaaacgttcatgaagagaagtgcgtctagttagtacctcatactaatacgaggtaatattatttctgaataataaatcacaggaatggaaaagcgggtgttatacaatgttgcaacatacatcttcagcattaaaacgaatgcgcgcgaaatactttgctgcatcagaactggcagagtcagtcattcagcaaatcttgatggacatacaggaatacgaccgcattttggaaatcgggaccggaaacggctcaatgtttaaacaaatcatcggacagcttgaaaagggcagtcttaaaagcatagaaacatcgaaacgtaaaatacggaaaacacagcgcgcaaaccgttcggttataaaagccgggcgcggaaacattcagcaggggaggcctgaaagcttaccgttccgcgatcgcagctttcataaagttttctcattacatactgctgaaacagtcagcgattacaggacagcatgtaaagaagtgtaccgcgttcttcaaattgacgggtgtttctatatggttttgaaaccttcgcggatgagtgagaaggatgtgattgaggtgctctatgatcagcatttcagagacatttcagttgtcagcagagattcattccattttattactgccattaaatagaatatttcttgggaaataaaaagagctgcttaagtcactgcagctctttttgtgaaattgggcatatttccttatttttggttatttcacatctattttatattaaaaaaagtttttttcttatacaatggtaatcagatgaccgtacattttaaatgttttgaacaaacggaatgaatattcattccgcatctggaaagggggatgaaatgacagcttcaaacaaggttgaactcattatgaaagcgtcgcttactttgtttacagatagaggatttgacgcaacgacgattccgatgattgccgctcaggccgatgtcggaaccggcacaatctaccgttactttgacagtaaagagacacttgtgaacgtactgtatcaggaaagtgcgcagcgttttatgaaaaaagtcaaaacggactttcagggtatctctgtaagagaagggtttcatcacctgttttattgtctgattgattttacgaaggaaagtgagtatgcattgttttttcttgaaacgaataaggacgcctactttctgaatgaaacgagccgtaagcttcttgatgaaataacacagatgcttgacgtcttttttcagcgcggcaagtctgaaggtgtgctccgcaatctgccgtccaatgtgctgatggcgctgctgctcggggcatatctcaaactctatcagcttatccggacgggaagcgtcgaaataacaaaaccgtttctgaaagaattggaacaatgttcttgggatgccatcagaactcattaactattcgccgaaggaaggaagatcgatatgaaacagctaagcgctataccgcagccgaaaacatacggacctctgaaaaatctccctcacttggaaaaagaaaaactgtcacaatcgctctggaaaattgccgaagaatacggcccgatctttcgtttcgaatttccgagctctgtcggggtcttcgtctcaggccgcgagctcgcggcagaagtctgtgatgaaaagcgatttgataaaaacctcagcaaagccttgctgaaagtccgtgagtttggcggtgacggactatttacgagctggactcacgaaaagaattggcagaaagcgcatcggattttattgccgagcttcagccagaaggcgatgaaaggctatcattcaatgatgcttgatattgccatgcagcttgtgcagaagtggagcagattaaatccgaatgaagaaattgacgttgccgaagatatgacgcgcctgacgctggatacaatcggcctgtgcggatttcattaccgctttaacagcttttaccgcgacacacagcatccttttatcacaagtatgcttcgcgcgctgcaggaggcaatgcgccaatcacagagacacagcctgcaggacaagctgatgatcaaaacgagacatcagttccagcaggatattgaagtgatgaatgaactcgtagaccggatcatcgctgagcggagggaaaatccggatgagaatctgtctgatcttttagcattgatgcttgaagcgaaagatcctgtaacgggtgaaaggctggatgatgaaaatatccgctatcaaatcattacctttttgatcgcggggcatgaaaccacaagcggactgctttcattcgcgatttactgcctgctgaaaaataaagataaattgaaaaaagccgttcaggaagccgagcgggtgctgacgggagagacacctgaatataagcagattcagcagctgacatatacccgcatggtgttgaacgagactttacggctgtatccgactgccccggcattttccctgtacgcgaaagaagatacggttctcggcgggaaatatccgattgcgaaaggacagccggtgacgattctgactccgcagcttcaccgggataaaagcgcgtggggagaagatgccgagctattccgtccggaaaggttcagcgatcccgcggcaattccggctgatgcgtataagccgttcggaaacggacagcgcgcatgcatcgggatgcagtttgccctgcaggaagcgacaatggtgctcggccttgtccttaaacactttgaactgattgatcatactgattatgagcttacgattaaagaagctttaaccattaagcccggtgattttaaaatccgtgtaaaaaacaaggacgtgtccaatcatcagcccgtacaaaaccataaagctgaaggcggcggtcacaaagaagaaacgaaagaaatcccgtcccacggaacgccgcttctcattctttacggatcaaatttaggaactgcggaaggaatcgcggaagagctggctgacatcggcagaagcaaaggattttcaactgaaaccggcccgctcgatgattatgccgggaaactgcctgtaaaaggcgcagtcgttattgtgacggcttcttataacggggcgccgcctgataatgcggcgggttttgtgaaatggatggaaacccttgaagatcaggaattaaagggtgtttcttacgccgtcttcggctgcggagaccgtaactgggccgccacttaccagagggtaccccgcctgatagacaaagtgcttgaagaaaaaggggcaaaacggctgacttctatcggggagggcgacaatgccgatgattttgagtacagtcaggaagcctgggaagactcattctggaaggacatcatgaaggcttttcatatagaggccgctccaaaacaggcaaacaaatcacagttatcaatcgaatacgtaagtgaagcagccgagacgccgattgccaaaacgtacaaagcatttgaggcggaagtcatcacaaacaaagagcttcataccgaaagcagcaagcgttcagtccggcatattgagctgcgtctcccgaagaccgaaacgtatcgggaaggagaccatctcggggtgcttccgcaaaacagcggggaactgatcagccgtgtcattcgccgattcggtctcgacccaaatcagcactttaagatcaagggccggcagctgcctcatctgccgatggaccggccggttaatgcgccggagcttttggcgtcatatgtagagctgcaggaaccggcaacgagagcccagcttcgcgaacttgccgcccataccgtgtgcccgccgcaccaaaaagaattggagcatctttattctgacgatgcggcatataaagaaaacgtgctgaaaaaacgaatgaccatgctggacctgctggaagattatccggcgtgtgaactgccgtttgagcgctttttagaacttctgccgtccttaaaggcgcgctattattcaatctcaagctcaccgaaggcaaacaaaagggagctcagtatcacggtcggcgttgtgacggctccggcgtggagcggccggggagaatacaagggcgtggcttcgaactatttagccggattacaaaatggcgattctgccgtctgtttcatccgctcgccgcagtcgggtttcgcattgcccgaaattacgaaaacgcctctcattatgatcggagcaggcaccggaattgcaccgttcaggggatttatccaggcgcgggctgcagaaaaaatgtccggtaacagcctgggcgaagctcatttatacttcggctgcagacaccctgaagaagacgatctgtacaaagatgaattcgaccatgcggagaaaaacggccttgtcaccgtgcatcgggcgtattccagattagatcaggactgtaaagtttacgtacaggatgtcctgcttcgcgaggctgcacagattattgcgcttcttgaccaaggcggccatctctatatatgcggagacggaagcaaaatggctccggctgtcgaaaatgtactgcttcaggcgtatgaaaaggtgcataacactgattcaaaagtttcctcgaattggcttgaacagctgcaggcggaaggaagatatgcgaaagatgtttgggcaggtgtgtaacagaagcgtaaggcaattgaagattgtgttttaattgaagaaagccggcacgatatttgaaatctactgaatcaaaaggaatagttatagggagtatcgtgccggccttatctttagtatcggacaaaagacacaaatctttaatgtttttattgatttacatgcaggcggctatgtcccttttttctgaattccgccagaaataaaaccggataagacagcaatagcaaaaccgaaataaatgaaatgataccgatccaatgaaaatgcgtccaaaagaaaccgccgcaagacccggccgcgcttgacccgatatagtatgcaagcagatataatgaagaagcttgcgcgcgctgatcaccggctgctcggccgacccaggcgcttgcaattgaatgtgcgccgaaaaagccgaaggtaaacacggcaatgcccgcaattttaagggcaagctggggcaaaagtgtcaccgctgcgccggcaagcataacaaaaatcgcaatcttaatcatttttgcacttccgaaaagatctgcttttttccccatatagacagagctgaacgttcccgcgagatagacaataaaaataaaaccgattacagtctgtgacaaatgataaggagccgccattaaatgaaagccgatataattatataatgtcacaaaactccccattaatataaatcccagagatattaacaaaagcagccgtttgcggtgtagaaccgctccgtattccttacatgccgcttttacgcccgcatgccgctgagatgaatggcgcggagccggaagaaaacgccaaaacaaatagcttaatataatagaaagaatgccgataatggcaagcgccggccgccagccgaatacatcagtcagaagccccgttaacagcctgccgctcattcccccgatgcttgtgccgctgatatacaggcccatcattttcccgaggcccttcggatcaaactcctcgcctacatatgtcatagcgacagcaggaacgcctgccagaaaaataccgagcagccccctcatcgccaaaagcgccggaaaagccggactgaacgctgttaatagacctaaaacagaagtggctgttaacgacagcaccattaatttttttctgccgaatccgtcagacaacgaagcagcggccaataatgaaaatgccaaaacggctgttgagatggataaagttaagctggcagccgcagcggaaatatgaaactcttccgaaaacaaaggcataagcggctgtgtcgtgtaaagcgtggcaaatgtcacaaagccgctgataaacagtgccaagctggcctttctgtaagcctttgtatgaggctgaataaacgtcatgaatgtccctcttttctcactgttggttatatatgtatcgtacgcttttcatttcaatgtgtctaatttataataactatagaattaatgcgtgtaggttatgaagaaaggggagaaggagaaaatggagcttcatcaaattgacaacttcattgcggcggcaactcatcagcatttcacaaatgcggcaaaagaaagaatgatttctcagccggcattaagccgatcgattatcaggctcgaagaagaattaggcgcgccgttattttacagagagacaaaagccgtccggctgacaaggcacggagagcagttcttaataaaagcaaaacaagcgagacgagctttaaatgaaggcgttgaacaagtgaaaaaaaatatgagcctggagcacggcgaaatatctgtatcttttcttcatacgctcgggttgcgcttgatgcctcagctgattgccgaatttaaaaagctatacccaaacgtgaccttccggctgtatcaaggcgcaaatgaaacgcttcgcaaaatggtggaaacgggagatgcggatatctgtctcagctccccgccgcttcccagcgagcttttacaatggacagtgctggagaaagagcctctttatgcggtgcttcctgagaaccacccgcttgcagaaaataaaagcattcaaatgaaagagatgcaggacgaggattttgtcggatttaaaccgggatacgggctgagatatatgtttgatctgatgtgccgggatttgaatatacacccgcatctcgcatttgaaggagaggaagtgtcaaccatattagggctgaccgccgcgggtcttggggctgcagtgctgccgaaaaccgcggagcattcatactttccggtcgtttttctcccggttgcagattaccaatgcgaacgcaccatagcgttagcccagttaaaaaaccatgctctctctcccgctgctgagcgttttaaacagtttgcacttgattattacaaagcacgcaactgagcggtcattttattaaaatcgaagttgaaaataaagcagaaagaaatacagaaaacggaggataaccatggcgaaaaaaacagtgaaaacaaatgctgtccgtatcattgagcagcaaaacattccctatgagctattaggttacaaaacagaagggggacagcccgcagacggtctttccgtttcacaaaaaatcggatactctgccgaatatgtttataaaaccttagtggcatctgcaggaactgatcgttattacgtctttgtcgttcccgttgcaaaagaactgaatctgaaaaaggctgcgaaggcggcaggtgagaagaaaatagaaatgattgccatgaaggaccttttgggagtgaccggctatatacgcggcggctgctctccgatcggaatgaaaaaaaggtttcctacttttattgatagatccgctgaaacactggcgtttatgattgtcagtgcggggaaaatcggaatgcagctaaaagtagcgcctcatgatttagccgaagcaagcggggcggtatttacagacattgtataaatgtccggtggatctaatggaatacacgtttcaagggagaatgataatgaaaaaaagatatgaaaacttgaatggcgtgaagaatgaacatggattcatggacatgtggaaatggatgaaagaacgaagagaaaaaagtaaagatttaagcgagaatattccgaaagcggtcacaagggatgtccgtgatgttgccgtcaatcggacggaaaccgccataacatggatcggccattcttcatttctgatccaaatacaggggcttaacataatgaccgaccctgtatgggcgcggaggatgggttttcaaaaacggctgacagagccgggatatgaattgagcgaactgcctgacattgatgccgtgctcatctcacatgggcattatgaccatcttgattttccgagtataaaaaaactgagaggaaacccggatttttacgtgcctgcgggattgaaaaagctgttcatcaaaaaaggccgcaaaaaggttcatgaaatgaattggtggggtcgttttgagatgcggggggtgaatatatcatttgttccggcccagcactggacccggagaacgctttgggataccgatacttctcattggggaggctgggtcatagaaagcgaaaacggcgagtccatctattttgcaggagatacaggctattttgaaggctttaaagaaatcggagagaggtttcgtattaaggcggccctgatgccgatcggagcatacgaacccgaatggtttatgaaagtgtcacatatcaatccggaagacgccgtgaaagcttttttagagctgaaggctgacagcttcattcccatgcattacggggcattccggcttgctgatgatacaggcccggaagcattaagcagactgcacggtgagtgggaccggcttgcattacctcctgaaaacctgagagcattagcgcttggcgaaacattttggctgtaacagcaggttttcgctgccgacaccaatcgtttaaaaacggttggtgttttgttgtcaaccaaaggtgaacagcctcagtataaaacatgatttttccggaatctgcggtaaaaaacaaaactttttactcttttgtttcactatacaatgaaaacggtttcgtatgcgcggtatatttaacctatcacaattgctccagcagaaacggacaggaaggatagaaaaacagatgaaatacatgaattcaagacagaaaaagattttgtatctgttgttatctgaacctgatgactacttagttgtgcaagatttcgcagacagggtccgctgttctgaaaaaacgatcaggaatgatttgaaaacgattgaagatttcctgaatgaacatgctcaagctcagctgatccgtaaaccgggattaggcgtctatttacatatatctgaacaggaaagatcacggttaagccggcacatttataatgagcactttacatgcaggcacaagaccgatgaagaaagaatacttcacatcgcttatgatttattaatgaattcaaagcccgtttccgcaaaagaaattgccgcacagcattttgtaaacagagcttccattaaaaaggatatcagtgcggttgaagagtggctgaagcgatttgatctcacactggtttctaaacagcggctcggcttaaagattgaaggggacgaaaaaaacaaaagaaaagcattggcgcgaatttcagatttgattgataatgcggagtttacaagccaatttataaaaagtaagtttttaagtcatgaagcggactttgtgagaaaagaaatcaagttattacaaaaaaaccattctatctattttacggatgaaacatttgaaagtttgctgctgcatacattgctgaccatccgccgtatcaaaatgaaacagccggtcgccatctctgcaaggcagctggaggcggtaaaaaagaagaaagaatatgaatggacactggcttgtttaaaacggcttgagccggtatttgccatccggtttcccgaggaagaagccgtctatttaactttacatataataggcgggaaagtgcgctatccattgcagcaagaaaagaagcttgatcttgaagattctgagctttccaaagtcgtcaggcatttgatcaatcgcgtttcagaactgaaaatgctggatttccataaagaccaggaattgatcaatggattgaacattcatctcgatccggtgttgaagcggctgagctatgatctctctgtttcaaaccccatgctccacgacatcaaaaaaatgtatccttatttgtttcatcttatcattgacgttttagaagacatcaatcaaacatttgatctttatattcctgaagaagaggcggcctatttgaccctgcattttcaggcagcgatcgaacggctgcgccgaagcagtcataaccctaaaaggacgatcatcgtctgccatatgggcattggcatgtcgcaattgctgcggactaaaattgaacgcaaatttcatcacattacgataaaagactgtatcgcaaaagcggaactgacagagtatatcaaaaagcataaagatatagatttcgtcatttctacgatagggcttggaaatgtaacgatccctcatatcgtcgtatcaccgcttttggagcctgctgatgaaaagaagctcagcgcatttatgcaacagcttgatacatcacaccgccgggagcaaaaaacgtttaaaatgctgaatgatacgactccgtttctcgtttttttacagcaagagacagagcaccgttatcaggtcattgaaaagctggcgcaggctttgtatgaaaaaggctatgtagaaaaagagtatggcattcatgcagtaatgagagaaaaaatgtcggcgacaaatatcggggcgggtattgccatccctcacgcgaactctaaatatatcaaacaatcagccattgcaatcgccaccttaaaagagcccattgagtgggggacggaaaaggtgtcgcttgtatttatgcttgccgtcaaacacgaagatcaaaacaaggtaaagcaattattcagtgagctttcctatcttagcgagcagccggcatttattcaaaaactgacggaagaaaaaaatgtgatgacgtttttatcgtatttaaactattaaaagcaggggatggctccctgctttttttctgtttatagggaaaaatgccgttatttccggaacttatggtaaaaaaacgcgcttatcacaggctgatttcagtataaagttgagacaagatcttgaaattcagactgcaaaggaggatttatatgaaactgttagcgattacatcatgtccgaacggcattgcccatacgtatatggctgctgaaaatttacaaaaagcagccggcagattaggcgttgagatcaaagtggaaacccagggcggaatcggggtggaaaataggctgaccgaagaggaaatccgggaagcagacgcaatcattatcgcggcggaccgttcggtgaacaaagaccgattcgcgggaaaaaagctgctggccgtcggggttcaggaaggcatccgcaaaccggaagaattaattcaaagagcgcttagcggtgaagtgccggtctatcaatctgcttcaaaaactgaatccgcaagtcagcagggcaaaaaacaaaacccgatttaccgtcatttaatgaacggcgtttcttttatggttcctttcattgtcgtcggcggattattgatagcggttgcattgacgcttggaggagaaaaaacaccaaagggcttagtcattccggatgcgtctttttggaaaacgattgaacagatcggcagcgcttctttttcattcatgatcccgattttagccgggtacatcgcgttcagcatcgccgataagccgggtcttgtccccggaatgatcggcggatatattgcggcatccggcagcttttacgacagtgcgagcggcgcaggatttcttggaggaatcattgcgggatttttggcgggatatgcggcgcttggaatcaaaaaatgtaaagttcctaaagcaatacagccgattatgccgatcattattattccggtgtttgcctcactgatcgtcggtttggcgtttgtatttctgatcggcgcccccgtcgctcatattttcgcatcattaacggtttggcttgcgggaatgaaaggctcgagctcaattctcctggcattgattttaggagcgatgatctcctttgatatgggaggacccgtaaacaaggtggcctttctattcggatcggcaatgatcggagaaggaaattatgaaattatgggcccgattgccgtttccatttgtataccgccgatagggcttgggattgcgacgtttttaggaaaaagaaaattcgccgccgcagaaaaagaaatgggaaaagcgtcatttacgatgggccttttcggtatcacggaaggagccattccatttgcggcccaagatccccttcgtgtgatcccgagtattatggcgggttctatgaccggctcggtgatagcgatgatcggccatgtgggggacagagtggcacacggcggccccatcgttgctgtacttggagcagtagatcatgtattgatgttttttatcgctgtaacagcaggctctcttgtcaccgctctgttggttaatgtactgaagaaagatatggcgaaatcccccgcgcccggtgaggtgctgccgtctgccgcaccaaatgaagctgcagcggcaaaagaaacaaaggaaccatctcaggctgacagccgaaaagccgggatgaccgaaatcaaaaaactgactgacattatcagcacggacttgattgaaccgcatttatccggcgaaacgagggatgacattatcgatgaaatgatcgagaaattgtcccgtaaaggtatgcttctgtctgacagcggatttaaacaggccattttgagccgtgaacagcagggaaccacggcgataggtatgaatatcgccattccgcacggaaagtctgatgccgtcagaacgccgggtgtcgcattcggaataagacgttcgggtgttgactggaacagccttgatggttctgatgcaaaactgatttttatgattgccgtaccgaaggaaagcggcggaaatcagcatctgaaaatattgcagatgttatcccgaaaactgatggatgacagctatcgggaaaggctgctctccgttcagacaaaagaagaggcgtatgggcttctggaagaaatcgaataaagcgggggatgatcatgtctactgaaccgatatttttcaatccggttttcaaagaaagaatttggggaggcgccgccctgcgtgatttccactataatattccgtccgagcggacaggggagtgctgggcctttgccgctcatcaaaatggacagagcacagttcgaaacggcatgtataaaggatgtacgctcggtgaattgtgggagcatcacagagatttattcggaaaccttgaaggagaccgttttcctcttcttacaaaaattttggatgcggaccaagatctgtccgttcaggtgcatccggatgatgactttgccaaaatgcatgaaaacggggaacttggaaaaaccgaatgctggtatatcattgattgtgaaaaagatgcggagatcattttcggccacagcgcaacaacaaaagaagaactgatatccatgattgagcgcggagaatgggacggacttctgaacagagttaaggtaaagccgggagatttcttctttgtcccaagcggcaccgttcacgcgattggaaagggcacacttattttagagacgcagcaaaattcagatacgacttacagattgtatgattacggaagaaaagatgcggacggcaggctgcgcgagctccatttggaaaaaagtatagaagtgacagacgttccatctgtccgtgaacggccgaccgttcaatataaacaaacagatgatctgctggcagctgttttaatagaatgtccttatttttcagtcgaaaagtgggatgtaaaaggtgaagcgaatttattccagaatcatcccttccttcttgtcagcgtgatcgaaggagacggaataataattgcaggcgggcatgaacatccctttagaaaaggagatcacattctcctgccttccggtttgggagaatataaactggcgggccatgcaaagtgtattgtgtctcatctgtaatcttcaaaacccttctctggcagcagagaagggtttttcatcacttttacaaaaaggccgaaatttccgtggtccgttcctgaatttaatctctcaatttgtatatctcccgagccattgattcaagtatgtacatagcggggatttgggtggtgatattcgcattttcaacccattcttccgtcacgtaatatgaaatattcacatcagacattttggcaatggttgaatgtttatgatttgtaatactgatgacccggcttccttcttgtttcagctgattcagatgagtcaccgtagaatctccttcacctgaaaccgataatgcgatcgtgatgctgttatggcggaaatgggaatgggccggaaagtaaggatctttaatatacattgaaagtttccctaagcacgaaaaatatctggctccgtattcggcgagaattcctgaactacccactccgataaaaatgacgctttctgcatcggctgcaagggctgctgcttccttcagcttttcttccatccctccgcttactgttctttcaaaaaactcggcaacggaatgatggggactctttaaaatcgtttttttatttgcctccgcatacattttcagcttcaccttaaactccgaaaacccttcacagtttatttttttgcagaaacgtaaaatagaagccgtcgatacatgggtttcatttgccaattcacggattcgcatatagacgactttctcgctgttttgggagatgtagttgtataaagaagtttcaagctcgttaaatgaagcaatcatttcgtgtgtgaacatgcagggggattctcctttttatgagaatggtgaatgtacatctcatcgtaacatatcatttttaaaagaaacatagtgttatatttatgtgacaaatcactttttgtgtcattcaaaacaagacgtcagccaatgatttacggtgcaaaacaactgcggatataattcgttcatacgcttatgcatgatctcttcaagggtctctgacaaaagcggtcgaaaaaaggaggacaatatgagtatcaaactgatagcggttgatatggacggaacgtttttgaatgatgaaatggcatataacaaagagcgttttatgaatcagtatcgtgaattaaaagcgcggggaattaaatttgccgtagcaagcggaaaccaatatgcgcagcttacatccttctttccggaaatcaaaagtgaaatcgctttcgttgccgagaatggcgctttcgtcgtgaatgccggagaagaattattcgcgggtaacatgtctgaagacactataaaagaggtgatccgtgctttagagcagtatgaggtgaaaaacgtcattgtctgcggaaaaaaaagcgcgtatattcatgaaaatgccagtgaggatgaatatctgcatgccagtaagtattattatgtgttaaaaagggtgccgcattttgaaaacatcgatgatgacattttaaaattttccatcagttttcccgccgaacattgttccgcacttctgaggcatttaaaagacgccatcgggtctttcgtcacgcctgtatcaagcgggcacggtgacatagatctgatcataccggggcttcataaagcaagcgggattaggcttctccagaaacaatgggggataaatgatgaagaatgtgcggccttcggagacagcggcaatgatttggagatggtgtctgccgtgaaatacggagtcgctatggataatgcgcaggaaagcattaaacaggccgcggcgcatatcgcgcaatcaaacaatgaggaaggggtcttaaacgcgattgattccattctcaaatgtgaaaaaccctttgtctgaaaaagacattttaactgcggaggtgctgaacgatgattaaattagtgattacggatttagacggcacatttttaaataatcaaggcgattttgacagaacgttatttgaaaagacaaaacgagtaatggaagaacagcatgtcgctttcgccatctgcaccgggaaacagtgtgaaagggtggaagccttattcggagaagacgcgaaagatttttggattttaggagacagtgccgcacgtatgaaaaagaacggcaaattcgtatatgaatctttgatcagcaataaagccggactgtcaattataggcgctttagaaaaaatcagctgcgggcacaccattatcgcgtgcacaaaaaaaggcgcgatcgtaaaagaaaatctgtctgaaagtgaaatgaaatatgtaaatgcctcttatgcacatgtaacgaaaataactgattttactgagataaaagacgattttatcaagattacggttcatgaccccgacgccaactgtccggaaacgagagaaaagctgcatgaattttttcaccaattatatatcgtagcatcagaagatacctggatggacatatcaaatatcggaatacataaaggatcaacagtacaagaactgcagcgattattaggggtttcggctgatgaaacaatggcattcggagacggccgcaatgacaaagaattgatggaagcggcttcctacagctttgcggttaagaacgccattgacgaaataaaagatgcggcgcactttgtcatcaaatcaaatgacgaaagcagcgtcatgcacacgattatgagaatattagcgctgcaaaaacaatgagaaagcagatgggctaaagccaatgcggcaggacttactaggaaaagaaaaagcgggctatcctccgactttaaatcactcctgattttccgaaaatatgttaaaaatgaataaatatctatatttgacccaattgtattggtataatatgtataaaatgaatgaaacggcgtaatatcaagatgaaataaatcacttcatatcatttgatatcagacaaaaagtaggaacttcctcgttttgaaattgggaggtgtttgtattagcccgctgttgagtcccgcgtatatcattctcatttttcttccagcagcttcttttctgttagggattttaggatatttcatcttcaaaaaagtatggatgatggttgttattgtattcattttgtccttgatatttatgtttattgtaataggtgccgaaccgacatttttcatttgggtggctatgatgacggggagctgttttatctccggttcaatcactaagacggtatggacttttgtaaagcgaaaatattagacacagaagaatcctgtttgaacagctatccttttttgccgattgaagaaaaggaagtatagagtgatctgttatgttcttatattttgtctgttattgtattgtctgtgtatcgttttgttcttttttaactaaacggagcgctataattgaactgcagatatatagaaacacaaaaaaggataaggaggatttttatgtttcaaaccttagaccattttttgaaatcttgggaattcgaagccgatgcgacacaaaaactgctgaatcatctgactgatgaatcacttaaacaagaaatcacttcacaacattggactttaggccgtattgcatggcatactgtcgcggccattcatatcattacctcgaacacagatttaacgttccacgctccggctgaagattatcctgttcctgcatcggcgcggtttattgctgagagttatcatcaagccagtaatgcatttgtgcaggcgttaaaaacgcaatggactgacgatacacttcaagaatgtgtcaactttattggtcagcaattgccgaatggttcacttttgatgtttttaattcaacatcaaaaccatcatcgaggacaaatgactgtccttatgagacaagcaggtttacctgttccgggtatttatggtccggcaaaagaggaatggacaacatttggtttggaagctccgaaataggatgttgttgtaagggctcgaacgaatagatgataccaatcaatgttggtatcttttttgtattagtcttcgtgacatgcagacgaatcaacagttcaaaaggtgtaaagtgagttcaataactgcagaaaggcgattatgatgataactaaaatgactcaattcaatatgaaagacttcaataaaccaaacgaacctttcgttgtttcagggagaatcatcccttcatttgaaaacaatgtttggacatatacagaggagaaatttgctgaaccttatgtcaaaaaatatgacgatgaagacattgatgtcagttatgctgaagaagaggataaagttgtctttttttattacgcagagaacgactgtgtcggccggagtaagcttcgttctaattggaatggatacgcactgattgaagacattgccgttgcaaaagattatagaaaaaatggtgtcgggacggctttattacataaagcgattgagtgggcaaaggagaatcatttatgcggtcttatgcttgaaacacaagatattaatgtttcagcttgtcatttttatgccaaaaataactttgtcataggagcggtcgatacaatgctttattccaatttttcaacagcaaatgaaattgcggttttttggtactgtaaattttaaatataacagtatttgatgtttcgtcatttagcgggtgtgtgccgcaaagtattcaaaacatcggcttgaggatttataataaggtatatcaatcaatgcagggggagttatgtatgaagtgcaaaaaaatgaacagggtacaattaaaagagggaagcgtatcaatggccctataaactgcgtctgccctcattaatggagggaaatttgtgaatacgccttattcacagtcagctttacggcacaaccaagtgttcatttggctttgtgttttgtcatttttcagcgtattaaatgaaatggttttgaacgtctcgttacctgatatcgccaacgattttcataaactgccagcgagtgcaaactgggtgaacacggcttttatgttaacattttccatcggaactgctctgtatgggaagttatcagatcagctgggcatcaaaaaactgctcctatttggaattatggtaaatggcttcggatcgatcattggatttgtcggacactctttctttcctgtactcattctggcccgatttattcaaggggctggtgcagccgcattcccggctcttgtgatggttgcagtagtacgctatattccgaaagaaaacaggggtaaagcatttggtctgatcgggtcgctggtggcaatgggggaaggtgtcggaccagctatcggcggaatgatcgctcattatattcactggtcatatttgctgcttattccgacagcaacagttatcaccgttccattcctgatgaaactgctggaaaaggaagaaagaatcagcgggcgctttgatatgacggggattatattaatgtctgcaggcaccgtattttttctgctgtttacaacgtcatatagaatgtcttttctgatcatcagtattctggctttcctgatatttgtgaaacatattaggaaaactcaagatccctttgttgaccctgcactggggaaaaatgttttgtttatgacgggcgtccttagcggaggcctgatattcggcactgctgcaggatttgtgtctatggttccttatatgatgaaagatgttcaccatttaagtactgcggcaattggaagcgggattatgttccccgggacgatgagcgtcatcatcttcggttacattggaggattgcttgttgatcggaaaggttctttgtgtgtgctgaccattgggattgtattgatgtcttccagctttttaatcgctgcctttttcatagatgcggcaccttggcttatgaccgtcataatcgtttttgtgtttggggggctctccttcacaaaaacggttatatctacaattgtgtctggcagtttgaaacaaaaggaagccggcgccggaatgagtctgcttaattttacgagctttttatcagagggaacgggtatttcgattgcaggcggtttattatcgatcagcttgctgaatcaaaggctgctgcctgttaacgatgatcattccgcttatttgtacagtaatatgctcattctttttacaggaatcgttgttatgagctggctggtaaccatgaatgtctataaacgttcgcgaagaaatgactaaaaagggaaaaggatcaaacttgataaaagttttgatcctttttttaaggagcttccttattacggaaccttttgccgatcaatgaaaggggcgttaaagtgaattacatttataagaaaaaggaaaagaaaaatggaaaattgtatcatttcaatcagagataaatgggagaatgcacttattgagtctgaacaaaaaaataatcgtaatcaattaccgtaacgagaaaacaaccaagttttcactgccaatcgagacttttgaaaaagtgtatgaggatattaaaataggccggagagaaagttaatcactgtttgaaaatgactatgaagttcgtaagcggtatggttttaaccgcatctggattcccctggcaaagtaaaggtctttagggatttatgtcaaaataatagtaagtaccttatgcaacagggagtttggttgcttcataaggagggggaagtatgaaaaataagattcacatattgggagcctctggtgtcggaacgtcaacattgggtgttgcattatcaaagcatttgccgcatacgcatcttgatactgatgattactattggacagataaattcactaaaaaaagagaaatcgctgaaagaagaaagttacttaaaaaagacttgacaataaatgagaaatggattctttctggcgcagtgtgccgctggggcgatgatctaaaaagttattttgaccttgtcatcttcttatggattccgcaggatatacggcttgagagattaaggcatagggaatttcagcgttatggaaacgaagtgttagccggcggcagtaaatatgaacaatcaaaaacatttttagagtgggcttctttatatgatcattccggaatggaagttagaagcaaagctttacacgaacattggatgtcggatttatcttgtccattgttaaaaattgaaggagattactcagtcaatgaaagagttgatcgtgtcttggattatctgaattctaattaaactaacggatggagataactgcaaaatccaaaagtcaaagacagttccggccattttaacggagctgttttttataccgccttcagtttgtctgttgtgaagtgatttattctcggaaagaagcagcggaattaatagagaactcacttcgggaaaccgtgaaggcaggaatcaaaacgggagacttggcggtcaatcatcaacgtcagactttgcagaagaattgcagaaatgatcggatgttaaggcggaaaataagaagtgagaagcagatcatcaaaacgcaatacacctcaatttatattttcagtaagatcggctctgctcattaaaaaactcaattcgaagattagcggcatcaatattgccgcagatggggttagtgacataaagaggaagggataagaccccttccttaaaacctttaattcctctaatttcattgtcagatatattccttttttgaaatgggtatccaaatttcacttttaaaagatggcgatgttacatccttatgctcgttccacaggatttctgggccttcaatttgttcataatgtgacgatggaaaccattcggaataaatccgcccccatacttcctgcagtgcatccggaaatgatccggctgcttcgaatacagcccatgttgaggcagggacttcaagctgtgataggtgatttgggcaatgtttcgttgtggctgcgccaatatagtgatcaagctctccgttttcctctgtcctgccttcagaaaagttcgtggatgcactgatgagtcctgcaggcgctgtattagaaagctcttttagttgtttgattgctgcttcatctaaactttcccacatcgatgcaatgtcaggattcacgcctttgaacaaaatagggactctttttttaatgccgacgatgcgaaatgcctctttttcttcaatgcgatagttcatttcatttcctcctttgattgataactggaaggtcattcgcggataagctttaagtgaatggccattatgtttaacttctgatgggtttatgccatgcagattttgaaatgctcgtgcaaaagaatctggtgagtgataaccgtattttattgcaagatcaatcacctttacgcggctgtctttaagttcaaaagctgcaagagtaagacgtctgcggcgaatatattccgataatgaaatacctgtaaggaaggaaaacatccttttaaaatgatattcagagcagaaagcaagccttgctgcttctttgaaatcaatagcgttcgtgaggttttcttcaatatacgttaatgcgctgttcatccttttaagcgaatccatttatttgacctcctttaacaaaagaataacaggagcgaaatgtatctgcccgacatttcgtgcacagttttgcaggataacttatatgtaataaattaagttactcacctgtatttgtacagataaagaaaacacctaataactgcttgggtttcataagatgaaagaaagttatcattgttttatattgaaaagaaaatagaaaaagacggagttttcttgcgggaggggtttactatcaatcaattgaaagctgcatacgcggaggcagttaaaaaattttagttgatgtcgagaacgatgttcatcttcactgcttgttcaattagaggaagtgattcttccttaagggagatcactttttttattcgactaaagcagcagtttagcggaagaaggagaaaaatcagttgacttacttgaatactgaataggtgtaaaaagtggttattcatacggattgaaaaagaagaacacgcagcagactcacttgctcttgtttggggcaagtgttgacaaccctattagctggtttaattaaagaaggggtataaaacctgtatcaatgatgttactagatatctgcgacacaggttttatatttagctaaaatattcttatatattccacattgcatttttttattatgcaatagttcactctatttctgctttcaatttttcgaaccactctaaattaaccaagtgatgtgaacgggaattttcattcatacggcgaaagtaattgattgtgccgggaatttcttgagtgatggacaggtattcatcaaggagctcgattcgagttttagtctgatcgatttgtgattggatcagttccagtaatttatttttgtcgaattcatcggcaaagagtaacgccccataaaattgcaggttcacatattccgatttggtgccgtatttgatcattaatttttcaaattctgcccttcccgaatctgtgactttaaagttacggatttcacgcccgctggttgagggtttctgctgaatctgttcaatcaaacacttttcttcaagttgctgcagattgtaataaaatgaacctttcgtgaagttaacaatgtatttgtaatgacgtttttccattaaggccagaagttcatagccgtgagctccggggttttggatgagcaagccaaggataagtaagggaatcatggtttcatcaccttctccatccgcgcctcaaattccgcgtacgtgattttacccgaagccaaatccatactatgaaggtaaatctgttctgttttagaatagtcacccttcactttcagtgattgctcctctcccgaaatgggtttcaggatatggtgctttttcgagaaagcctcgaaatagcggtaaccgaatttgcgttgtgaagctgcgtctaaatgaatgccatcaggattcgcagtcaaacctgcagcagtaacaaaataacaattctgttgttcattagcaaaacgcagcaattgttcattaacctgtcgaaattcagtcgcgtgctgtccaaaaccggtcttcccaagaaagtcaccaagccctccaataatcaacggtacatcatcaagtttcaactcgtttcttagcgtctcaatgataagagttaatttctcgtaataagtttcatgcagcgaacgataactgtcactctcaccttggtgccaaaggattccgcaaatttgactggaacggagggcgaagcgggcttcggacaaagcatgctgaaaaaggatgccttccggatgccagtcattcaatgaactgccgccttccgcacaagggatcaagccaatttcttcatcgggatgagctttcgaccaagcatctgcaaaagatgccgccaagccaacgccggaaaccggacggtcgtaattaatcggctctgtcatcatctgccactgtccattgcgcagcatttttattttttcattatagatagggtctacttcattcaaaaatccacggcccgccatattcgactgccccaacattaaaaaagactttatcatttaatttttcacttctttacatcaatattttagtctaattagactatagtcaattcagcttgtcttgtaaagttctaataaggttttacttttattagtagtatgtatgaaaagcaaactaacattgaaaatttggtggatgtatttgagaaatagcaagttcttttgctttagatcttgataaacaatgaaaaacaacaaaaatcctgtcatgtaagggttcctatgaggttcaaaatcattaaaaaggttaacgattgtaccaattctattcatttgttatgttttacttttaaatcctgaagttatacttgaagaggaatgtcctaaaatgcagaaaaagccgggatgtcagatccggcttttcgctcactttcctttcttcttccgcttctccttttccgcccggtaaaactcatgaaacatcttcatcaatgcgcgtttttcaatccgcgacacgtaactccttgaaatgccgagctcctttgcgatctcgcgctgcgttttttctttttttagatcaagcccgaagcggccgacgatgacttctttttcgcggtcgtctaaaatatcgatatattttttgaccttttcaagttccatgttgagctgaatggtgtcgatcacatcctcgctttccgacttgaggacatcgatcaggcttatttcattcccttctttatcctggccgatcggatcatgaagggagacgtcttttttcgtttttttcaatgcgcgcagatgcattaaaatctcattttcaatacatcgtgcggcatatgtggcaagcttcgtgccttttccggctgagtagctttcaattcctttgatcagcccgattgtaccgatggagatcagatcttctgcgtcctctcccgtattttcgaattttttcacaatatgggcgactaaacggagattgtgttcgatcagcatgttgcgggcatgttcatcgccttcagccataaggtctaagtattttttctcctcactatttgagagcggttgtggaaaggcattatttttcacgtatgatactaaaaacacgagttctttcacaataaacccgagcgctgcaaaaacacctgtcaccatcctcacctccacaaagttatgtaggcaaaagcctatatgtaactgtatgtggcagtcaggctgtttgtgtctgtacagggaaattaatcaaaggcaggttttatttcttacagcctcttgatttttgctgattgagcctgtatattgttaaaaaaagtaagggtgaaaagaatataacgaaaagcgctgaagagacgagtagacagatatcattcatgacagagagctccgggagctgtgaaggagtatgaatggatgtgttgaaacaaacctcttagcttcgcatcggaatcatgaaaaacgaggatgatgcggcggatactcctgttaccgagtaagttttgtacccggcaagaggccggcaccaaaccgaattgaggtggcatagcgggctgtttcccgtcctcaagactttattgtcttgagggcgttttttatttctaagggagggataagatgaaaaacctgaagtcttggcggtacccgatgcttctgttaaccggaatcgggatagcaaatattggtgaatggatttattttttgtctcttaatcttattgttttaaaagaaacggggtctgcttttgcggtttccatcctttatttaatcaggcctgcggctgttttgatgacaaatgggtgggcgggcagcatcatcgacaggtgtaacaaacggaatatgatgatgtcgcttgatttcatccgggctgcattcattgccgttctgccgctgatgtttactgtaaggtctttgttttccatttattgtatcgtgtttttgattcaaatggccaatgcgatgtttcgtccgtgttccatggcgtatgtgacgatgcttattccggctgaaaggagaaaacgattcaattcactaagggctttgtcggaatcaggggcttttctcctcgggccggctgcggccgggctgctttttatcgccggcacgccgatttttgcgatttgggtgaatgcggcggctttagtgctgtccggtttcatcacgatgatgctgccgagccttgaaaatgagcctcacgtacattctcccagacagaagctttctttggcagtgtgcaaagaagattggaagctcgtctatcgcttcagccgaacggcgcgaaacgtcatgatcatttattttttattcagtctggtcatgaccgttatgccatccgcgcttgattcgcttgaagccgctttttcaaaagaagttcttcagctgactgatgccgattacggttttcttgtcagtgtctcaggggcaggcattattgcgggggcgcttgtcaatgtaatctttaataaaaaaatgccggcttctttattgatgggaatgggctctttattcacagcggccggatatatgatttatgcgttttctgacgttttttggacggctgctttcggatttttccttctcgctttttttctggcgtttgccaatacaggctttctgacgttttatcaaaagaatgttccggtggacatcatggggagagtggggagcttttattcattagtcgaagccgtcttcattatattggtaacggcggttttcggagcggcggctgtcggttcttccgtccgcgtcatcgtcatcgcaggggctgctgttatgctggcgttggcagccgttttatgctcgttcttatttgcggcctcaaaaaggaggactcccgatgtgtttcaagcggatcaatttaaagaaacataaagagacggccgtttcatttcgtgaggatgagtatctcaggtggctgtcatcccaaatctaatgctcacccgacaattttaagctgcttcttcataacgggcagccgatcggacagcttgaagcttccatcaacttttaccgcagccaaaaaatcggttatgtgcacctttactgagcagcaaagagaacgcggaacgaagctgcatcaatttagaattaaacggaaaagttctcagaatgagaggagccgtaccgccggaataggaggcggtacgcgcttcattttttcgttgtttttaaaagaccgggaaacttcttataaatgaccgccattaagacgagcatatacattccgtaaatcccgaaagacagcagtttgttgcttgtaaatgaagcgcctgcgacggtcacgatcacaatgttcggaattttgccgagcaccgacgcagaaaaaaagatcggccatcgtatgttactcagcccgcagacggtattcatggcaagcgacggtataatcggaatcagccgcccgaaaagcaccgccgtaaacgcgtgctgatgaaatgaaccttcatattgagccgcggccgggtaagccaccagtttttttctggcccagtctctgaatccgtaccggacgagaaaaaacaatgccattgttccgagcattgcgcctgacaatgtaatccacactccgtttacaatcccgaaaaccgctccgtttaaggccgcgataatggcgaatggaacgatcggaaaaaatacgtcagctgcgaccagaaggatactcataagcacggcatacatgccgcccgcgcgaatcatgctgagccagacgtctttttgcataaagccgatcatcacgacagcaatgatgacggcaagactgaatcccttttttatcatctgtacgttcacctcttttcaattagtatacagcacaaatctatctccttctattaaaataagctgtccgataagcgtacttgtttatcagcatttgccgtttgatgagaaacggctggcagccgggtttggacaaaaacatgcgggaagcgggtgatgtgcatcatttgatgcagagaatgattttatacaaaaggggacacgttaacagtagtgtttactggaggtgtaaacgttgagatgctttcatctgatcatcatgatatgcgtcctcacgggtctcactgccgtgtccgccgatgcgaaatctttaaaaagaagtgacatggagaagacgggaaacgtgtactgggatataaggtctgaaaaaaagaagctatctttaaccttcgatgacggcccccatcctgtctatacggaggctgtgttagacgtgctgaaacagcacaatgttaaagcaacctttttttgtatcgggagccgtatagacaaataccccgtaacggcaaaacgcatcgttgaagaagggcatgaaatcggcaaccatacgatgaaccatgtttattttcaccgtttaaaacgcaaagacattttacaagagcttcacagctccgcgcatcatatcagatcgctgcagccggaaggggacaagttattccgcccgccgggagggtcgctgaatcatacggctttcaaaagcctcttaaaagagggctatcatatcatcatgtggtcatggaaccaagatccgagggactggaaaaggcccggaaaaggaaaaatcgtcaggcacgttgtttcacatgccagagatggagatatcgttcttctgcatgacggcggaggaaaccggcgccagacggttgaggctttgaaagaaatcattccccagctgaaaaagcagggctacacgtttgttaaggtttcggatttgatcggacaggattccggtccttttcatatccagtaaagagagcgccgcgttgaaagccgccaaagagatgtgtaccataggaggtaaggtttggggggagagaaaatgaagtttgctgttctttttattacgataacctgtctgttatcaggatgcgctgcgggcaaagagaaaagtgttgtcgcgttcggcgacagcaatacgcgcggttccaactgggattatcgtgattatccgaaggcgcagcagtgggtaaacattttaaaaacagcggaacgcggccgtcttacggttataaatgcgggaataggcggccagacgactgaggatgcgcgcctgcgctttcaaagcgacgtgctggagcgtaagccccaatatttatttatcatgttcggaacaaatgatgcgggcattttgacgggagatcagccgcgagtatcaaagaaacggtttaaagaaaacctgacttatttcataaacgaaagcagaaatcacggcataaagccgattttaatgacgtgcatcccggttatagaaggaaacggaacgcatcatctctattactattcgagatataaagcctcagcctttaaagaaaaaggcggcgcgagaacatggcataattcctataacggcgttacgaggcaggttgcagctgagttgaaagtgccgctggtggataactggaaacactttatacgcgcggacggcggcaaagatacagaccgggcgctgatccaatccggactgatagatccctccggaaatcatatgacgccaaaaggcgccagaatcttaattgaaggcataaaaaatgggcgggttttggaacgctgacgccgtcagctgcctaaaccgttttgcttctgcttcataggctgtagaaaaaacatcttttggaggcgattgctatgaaccgcggtttccctccgcaatatcctgtatgcccgcctcctcgggtgaatgcggggtactggtacgcattttttgttgtgctgctcgtcgtcattctcgttctgggcggtctgtattggttcaatatatagcagccgtcctcttaaacacctctattttaggggtgttttttgttgaaagtggtagtaatgcgcataaccgaagtgatataatatcagtcatctgagtaaaaaaaggaaattcgcccgggaattttttctgtttaagaagaaacggaaataatgtgtccgagcgatcttcttttgatttcgttttcaattaactcgataaattcacggctcaaattcatttcattggctttgaaataagattctattagtaattcatcagaaagctttctcatgccggggacccaattaatgggagtggcacctccttacaattgtaatcaatcatcagacgcaagcatatgatggaaggttgcgtttcaatcatggtgaggttatctttaatctaccatgaaatacaaataagaacaatcgttctgttatccacactcgtaagtggataacttgttagtatcttgtttataatctggataaatccggatgtaataagagtggataatgtgtgtaattttatccacaactggtgaagaaacccaatttttgtcgaaatttttttaccgagtccgactttgtttttaaatctgacagatttcgacatatagatgatagaaagaaaaggaagggtgcgggttttgttaaaaaagttttttttacctgacgaatttgtgaaaaatatatttcatatcacaccggaaaagctcaaggaacgcaatgtgaaagggattattacagaccttgacaacacgcttgtggagtgggacagaccgagtgcgacacctcgattaatcgagtggtttgaagaaatgaaggagcacggcattaaagtcacgatcgtctccaataataatgaacgaagagtgaaattattctcggagccgcttggcataccgtttatttataaggcaagaaaaccgatggggcgcgcctttaaaagagctgtcagcagcatggagctgaaaaaagaagactgtgtggtcatcggcgatcagctgcttactgatgttctcggcggaaacagaaacgggtatcatacgatcctcgtcgtgcctgtcgcttcctctgacggagtcatgacgcgctttaaccgccggattgaacggagaatattgagttctttgaaacgtaaaggccatattcagtgggaggattaggaatggaaaaggttgtttgcatcggctgcggagtaacgatccagaccgaggataaacaaggtctcggatacgcgccaaaggcatcgctcacgaaggagaatgtcatttgtcagcgctgcttcagactgaaaaattacaatgaaattcaagatgtttcattaacggatgatgactttttaaatatcttgcacacaatcggcgatactgactctctaattgtcaaagtcgttgatatttttgattttaacggaagctggataaatgggctgaaccgctttgtcggcggtaatccgatcattcttgtcggtaataaggccgatatcctgccgaaatccgtaaagcgggaacggctcgtccaatggatgaaacgcgaagcgaaagaatacggcttaaaaccccttgatgtctttttaatcagcgcttcccgcggacaagggatgaaggaagtcattgacgccattgaacattaccgcgaagggcgggatgtgtatgtggtggggtgtaccaatgtcggcaaatccacatttatcaaccggattattaaagaggtctcaggggaagagaatattattaccacctctcaatttccgggcacgacgcttgatgcgattgaaatcccgcttgatgacggatctgcgctttatgatacgccgggaatcattaaccatcaccagatggcgcattacgtggacaagcgtgacttaaaggtgctgacaccgaaaaaagaactgaagccgcgcacttttcagctgaatgaaaaacaaacgctttatttcggcgggcttgcccggtttgactatgtatcaggcgataaaacggcgtttgtctgctatatgccgaatgaattgatgattcacagaacaaagcttgaaaatgctgatgccttatacgaaaagcatgcgggagaactgcttaccccgcccggaaaagatcatttggatgaatttccggagcttacggcccacacgtttacgattaaagaaggaaagacggatatcgttttttccggactcggctgggtcacggtgcagcaagcagataaaaaaataacggcatacgctccgaaaggcgtacacgtatttgtccgccgttcattaatatagagagaaggggagagggagcatgaaacaattgtacggagtaatcggaaatccgatcgggcattcaatgtcacccgatattcataacgcggctttgcaagataagaacatcaacgggcagtattttgcgtttcaggtggaacctcattatctcaaggacgccgttaacggaatcaaggcgcttggcatctgcggagtgaacgtcacagtcccgcataaagtcgcgatcatggagcatctggatgaaatacatgaaagcgcgaaagtactcggggccgtaaataccgtcaaaagagagggagacaggctcatcgggtataatactgacggagatgggttttataaatccttagtcaaagtattggacaaaccgatatcagagctctccatcctcatgattggggcgggaggggcggcaagagcgatttttacgacgatcgtccgcagagagccgaaacaatttgacgtttgcaaccgcacgccggaaaaagcggaaagtctgattgcggctgctccctcttttcagcagaaacgcgcccttactttaaaagaagctgaaaatcagcttgaacaatatgacgtcattattcatacaacatctgtcggcatgtatccgaaaacggatgccgtgccgctctcattggaacgggccaaaacgggcgccatcgtttgtgatatcgtatacaacccgattcaaacggcgttcttaaaagaagctgaaaaaagaggtttaacaacccttgacggtgtcggcatgtttgtggaacaggctgcactgtctttcaagctgtggacggaacaagagcctgacagcggcttaatgagagcaattgttgaaggaaaactaggaggaacacaatgttaacaggaaaacaaaaacggtttttgcgttcaaaagcgcatcatttaacgcctatttttcaagtgggaaaaggcggagtcaacgaaaacatggtgaaacagattgcagaggctttagaagcaagagagctgattaaagtcagcgtgcttcaaaactgcgaagacgataaaaacgatgtcgcagaagcgcttgtgaaaggcagccgctcacaattggtgcagacgatcggaaatacgatcgtattgtataaggaatcaaaggaaaataaacaaatcgagcttccgtaaggtggttgacatgaagaaaatcggaatattcgggggcacatttgaccctccgcacaacggacatcttctgatggctaatgaagtccttcatcaggcggagctcgatgagatttggtttatgcccaataaaatcccgccgcataagcagaatgaagactttacagacagccggcaccgggtggagatgctgaagcttgccatcagctctaattccttctttaagcttgagcttgcggaaatggaccggaaaggcccttcttatacctatgataccgtccgtttactgaaggagcggcacccgaacgacaagcttttctttattatcggggcggatatgattgaatatctgccgaaatggtacaaactggacgaactgctcacgctcattcaatttatcggagtgcggcgcccagggtatcatatcgagaccccgtacccgctgctttttgccgacgttccggaatttgacgtttcgtcaacgatgcttagagaacgtctcaaagcaaaaaagccgacgcaatacttaatgccggataaagtgaggcagtatatagaggagaatgatttatatgaatcgtgaggaagcacttgcctgcgtcaaagaacagctgaccgagcatcgctacatccacacaatcggcgtgacagatacggcggttattctcgcaggccggttcggagcagatccgaaaaaagcggaaatggcggctatttttcatgattatgcgaaattccggccgaaagaagaaatgaagcagatcatcgtgcgggaaaaaatgcctgctgagctcttggattacaatgccgagctgtggcatgcccctgtgggagcgtatttggctgagaaagaagcggggatcactgatcccgaggtcttggatgcaatccgctatcacacgtcagggcgtcccggaatgacccttttagacaaagtcatctacgttgcggattacattgaacccggccgccattttcccggagtggaagaggtgcgccgtctggcggaaacagatctgaacgaagcgctcatacaagcgatgaaaaatacaatgatatttctgatgaaaaaaaaccagccggtctttccggagacgtttgcaacctataactggctggtgtctcaaaaacgacaggaggaatatggaaaatgaatcaagcttccgtattaaaaatcgcggcaaaagcatgcgacgataaacgtgcagaagatattttagcgctggacatggaaggaatctcacttgtagcggattactttttaatctgccacgggaattctgataaacaggttcaggccattgcgcgcgaaattaaagatcaggcagaagaaaacggcattgatgtcaaaaagatggaagggtttgatgaggcccgctgggttttagttgatctcggcgacgtcattgtccacgttttccataaagatgaaagaagctactataatcttgaaaagctatggggcgacgcgccgctcgcagagcttgaactcggcttgaactcatgatttaccaaggcttcgccggtgtatatgacgagttaatgtcccatgcgccgtatgatgaatgggcgggctggatcgaagcgtctcttccggaaaagggaagggtgcttgatcttgcctgcggaaccggagaaatatccatcaggcttgctgaaaaaggctgcgaagtcacggggattgatttgagtgaagatatgctgagctgtgcccagcagaaaaaaacaggaaagccgattctttttctccagcaggatatgagagagctttccggttttgaagaacagtttgatgccgtagtcatctgctgtgattccctaaattacttaaaaacgaaaaatgatgtcttaagcaccttcaaaagtgtttttcaagttttgaaggagggcggcctgcttctgtttgacgtccattccccgtataaaatgacggagctttttccggacagcacccatgcggatcaggatgagcagatcagctatatctggcaaagctttgccggcgatgaagagctttctgtcatccatgatatgtcctttttcgtatggaacggacaatcttatgaccgctatgacgagacgcatgagcaaaaaacattttacattgaagaatataaacaaatgcttgcagagaccggatttgaattgaagaaagtgacggctgattttacagaccggcctccttcaacagagtctgaacgtcttttctttacggcaggcaaaccaaaaaccatcgtttaaacggaacgatggtttttaaaatgcattttttgcgattggcgtgataaagctctttatggcatactcagttacacgtgaaattgcttcttcactaacgatatatcttcatcgtatttgtcatgtgtacgctgaaagacacgattgaacatatcctgaacaccgctttcgagagccttcagtccttctccggtgacgccgccttttacgcatactttttcctgcaaggcgggaagcgtgtaatgccccgtttcaagaagctttccgagaccgacaagcatttctgtcgacataatcacggcttcttctttggtgatgtccgtttcttccactgccgcgtcaataaagcgctgaacgagataactcataaaagcgggcccgcagctgacaatgtctgacgccgctcttgtaataccgctgctgatttccacaggttttgaaatatgagtgaacagcgtttgaatatccgcttttgcagactcgctgcagcttttgccgaacgtaacaagcgagacgccggccaaggcgcggttcgtaatgctcggaatgacgcgggccgtctgacacggaaccgtatgttcaatctgatccgtctgaacggggctggtaatggagattaaaatgtgatctttccgtaaatgcggtgtgagttttttcagcaaaggatatatatccagcggttttacacaaatgaatatgatttcattatcctgtacgagcttttcctgatcctcggtgacgtggatgccgctgaaacgttcttttagttttaatgctttttcgattgttctgtttgtgatggtgatatgtgagggatcggcagcgtttgattcgataaacgattcaatcaggatcgttcccatgtttccggtgccgataaagcctattttcaatgaattcccctcctttttcccttaatcctctaaaccttatgcggggaggcaatgcaatatgacgaaagcgatgatgacggagcggatgcggcggaacctgaaaattctgggcgcttgtcttgcggcaggtgcggtttttatctgtatttggctgtttcgttctgaaaaggaagagccggtcaaacagcagtccgtgctcggtcaaacagcctccgcatccgtcgcggacaaaaaagacaccgcagacgataagattatgattgatgtgaaaggagcggtccgaaatcccggcgtgtatgaaatgaaagcgggagacagagtgacgcaagccattgaaaaagccggcggcctgaagaaaaaggcggatgaattgaatgttaatttagcagagcagctgcaggacgggacgattgtttatattccgagtgaaggcgaagaggagaatcgcccgaaaacagcagttggtgaaaaggagaatgcagctgtcaatatcaatacggcatctctggacgaacttcaggcgatttccggggtggggcagaaaaaagcggaagctattatcgcctaccgagaagaaaacggacggtttcagactgctgaagatttgatgaatgtatcaggctttggagaaaagtcatttgagcggataaaaacttccattacggtaaagtgaattgacggttctgcttaaatctatgtaaacttagaaaagcaacaagactttttggagggaacacttgtggaacgaatctcatggaatcaatattttatggcgcaaagccatttgctggcgctgagaagcacatgtccgagactgtcagtcggggcaaccgtagtcagagataagcggatgattgctggcggatacaacggctcaatcgccggcggcgtccattgcgctgatgaaggatgccttttaatagataatcattgccagaggaccatacatgcagagatgaatgcgattctgcaatgttctaagttcggtgttccgacggagggcgcggaaatttatgtgacgcattatccttgtattcaatgctgcaaatcaattatccaggcaggcatcaaaacggtctattatgccgaagattacaaaacacagccttatgcaaaagagctgttcagccaagccggagtcaaggtggagcaggtcgaacttgatgaaatgatcatcgatctgaaaaaccgcgaaaaattgtcttttgtcgcaggtctgattcagcaattatctgatgcgggagttaaggcagatgaactgaaaaaaattcatgaacaggccaatgagctgtttaccagttacgtataaatgaaatataaataccttcttctgcctctggcggcggtttctgcaactgcggggattgccgccgctcatgtcttctgggttctgctcctttttcttctgtatcttctctttattatgataaaaacaaagcagcctgctccggttatcatctgcctcgtttctttttgtgtttatttctttctttatacggtttgtgacgctgtgaatgtaacgcggtatcaggccggcagttatactgaacaggccgtcatcactaatattccgaaggttgacggagcgaaaatgtcagccgttatccgtacacatgacaaggaaaaatgggcggcttcgtacaaaatccggtctcttgaagaaaagagacgcattgaacagcttgaaccggggatgcgctgcacatttacaggctctctggaacagcctgcacatgcgacgattcccgggggttttgattataaggaatatctttactctcagcagattcactggttatttaccgtgacttccattcagcagtgtgaaaaatccaaacagccgctgtttaaactgctgagcatcagaaaaaatttgatttcgatcattcggaatcacgtgcctgaatcttccgccggaattgttgaagcgctgaccttaggtgaaagattttctatagaagacgatatactgagtgcatatcaaaatttgggagtcgttcatttaatggcgatttccggaatgcatgtcggtcttataacggcgggattattttatgctctgatcagaatcgggctgacaagagaaaaggcggggatattgctgctgctgtttttaccggtgtatacgctgctgagcggtgccgccccatccgtattgcgcgcatccctcatgctgggattttatatcgccggaactcttgttaaacgcggcattcattcctctgctgcattgtctctgtcttatctgctgctcctgctgtttaatccttacctcctttggcaggcgggcttccagctttcctttgcggtaagcgcctctttaattctgtcatcctccattttaaagaaagcagggaaaagcagacttgccgggcttgcgatggcttcattcattgcagagctcagctcacttccgtttcttctctatcattttcagcaaatttcacttgccagttttccgatgaatatggtgatggtgccattttatacgttatttgtcattccggtttctgtcatcggtttccttcttcttttactttcaaggcagatgggagaatgtttgtttaatatgtttgaccttgtgatgaagcctgtgcatgatttcattacatatgcggcatccgttgatttatttactatgattgtgttaaagcctgactttctttcccttcttctgcttgcggtttccgtttttacgctttttgcggctttagaaaagggaggttttttaaaactcaggaaatcggctctttttttctgcgcggttttggcttatttaatatgccgtccgtatttcagcccatggggagaagcggatatgcttgatatcgggcagggagactcgctgtttataaacgcgccgcaccgcaaagggaccgtaatggttgatacagggggagtgattgcttatcccggagaatcatggaaagaaaaacgccacccgtattctatcggcgagaaggttttgattccgtttttaaacggaaaaggggtgaaaaagctggatgcgctgattttaacccatgcggatcaggatcacatcggggaagccggagtgttaatcaaaaatcatagagtcaaacggttaattgtccccgtgggattcgtaaaagaaccgaaggatcagaacatattaaatatggcgaaagaaaacaacattcccgttgccgaagcaaagcggggcgacaccattacagccggtgatcttcagtttcaggtgctgtctccggagtcgtctgacggaaagagtaaaaatgattcgtcactggtgctttggacggttttaggcggagtgagctggcttttgacgggagatttagaatcggacggcgaaacagaagtgctgaaaacgtatccgaaactgaaggctgatatattgaaggcgggtcatcacggcagcaaaagctcaacgagtgaagcctttttgaaacagcttcagccggaagcagcgctgatttcagcaggaaaagagaatcgataccatcatccgcacgaagaagtgctggatcgtttgaaggcgtactctgtcaatgtgcttcgcaccgatatcagcggaacgattcaatacagatttgaaaaaggcgccggaacgttttccgtcttccctccatatgatatagaagaaaccagggcgcaagaagtaaaaaagactgccgattgacagcagcccggaatgcggctaagagccgataagatggatggctgttgccatcacgaacaaaaaggcgaaaaatccgaaggacacgacaaaaccgacagctgagtcaacagcatcatttcgtttgctttgaacgtttttttcaaaatcattcaatttcatccctcctgacttccctaagtatactggaattgttttgaaaaatctagaagtgatggtaacgttttctgttcttgtgattatcgcctttttacaagcagacccgggagcttgtgaatcaggcgtttattataaatgaggaagctgtcctttttaaagcttcctctttactatttgccgaactcaatttaggatagaaggggatcaagaaagagaggaagtcatacgatcatggtatttgatgtttggaaagccctgaaaaaaggggatgtccgctccgtttattgcttatacggaaaagaaacgtatctgctccaagagactgtcagccggatcagacaagctgtcgttgatgaggagactaaagattttaacctgtctgtttttgatcttgaagaggatccgcttgaccaggccataaccgatgcggaaacgtttccgtttatgggagagaagcggctggttatcgtaaaaaatccgtcttttttaacaggggaaaaaaagaaagaaaaaatagagcataatacaagcgctttggagacttacctgaaggagcctgcgccttatacggtctttgtgattgtggctccgtatgaaaagctggacgaacggaaaaagctgacgaaagcgctgaagcaaaaagcccttatgattgaagctaaggagctgaatgcaaaggagacgactgattttacgattaatctggcgaaatccgaaaataaaacgatggatacagaagctgccgagcatttggttctgcttgcaaacggccatctgtcttccatatatcaggaaatacaaaaactctccgcctacaccggtgacagacatgagatcacgcttgaagatgtccgggagcttgtcgcaagaagtttggagcagaatatttttgagctgatcaacaaaatcgtgaaccgaaaacggacggaaagtcttcaaatattttatgatcttttaaaacaaaacgaagaaccgatcaaaattatggcgctgatcgccaaccaattccgtctgattatgcagacaaagtattttgcgggacaaggatacggccaaaagcaaatcgcttccaacttaaaggtgcaccccttccgggtaaagctggcgatggatcaggcgaggctattttctgaagaagagctgcggcgtattatagaaaggctcgcagtaatggattatgaaatgaaaacggggaaaaaggacaagcagctcttgctggagctctttctccttgagcttctccggactgaatgaaaaaaacgatccccgttaaagggatcgtttttgtattatgcagaaagtccgttcacttgtttcgcaagtctagatttgtatcgagctgcggcatttttgtgtacaagacctgttttcactgctttatcaatgcgtttcgctgcttcagaaagagcagttttcgctttatccgcttcgttgttagcaacagaagcttcaacttgtttgattgcagtacgcatagcagatttgattgtcgcgttatgagcgcggcgttcgttgtttgtttttgtacgtttaatcgctgatttaatgtttggcatgtgtttcacctcctaagatacaacctgtagcacagtgtcttaaggttaaatcttcttcacaatagaacaaattgtattctatcaaacagaactttagattgcaatataaatgtaaagtatttttcgttgatgggtaaattcgcatgattcgttttgtaaatggccacactatgtaccacgatgattgaaggaggtctttcctgtgaaaaacaacgaactggatgtcaatcaatttctgatacggacggatttagcggtagaaacgaaacaggcggtaaaagacggacaagccggtcagacaaaagaaataaacgggtttattgaaaaagaacgcgacaagggcggcattaaagtcagaaccgtcgatattaccaaagaaggcgccgagctatcggggaaaaagcagggacgctatgtcacgatcgaggctcaaggggttcgggaacacgactctgacatgcaggaaaaagtaacggaagtgtttgccgaggaattttccgcctatctgtcggcattaaagattccaaaggatgcaagctgtttgatcgtcggtctcggcaactggaatgtgacgccggatgcgctcggccctctcgtgaccgaaaaccttcttgtgacaaggcatctgttcaggcttcagccggaaaacgtgcaggaagggtacaggccggtcagcgcgcttgctcccggtgtgatgggattaacgggaattgaaacgagcgatattattcaaggtgtgatcaaagaatcaaagccggattttgtgattgcggtagatgctcttgcggcaagagccgttgaaagggtgaacacgaccatccaattttctgatacgggcattcacccgggatcaggcgtcggcaataaaagaaaagaattaagcaaggaaacgctcggcatccccgtcatcgcaatcggggtaccgactgtcgttgatgcggttacgatcgcgagcgatacggtggattatatattaaagcatttcggcagagagatgaaagatgacagcccgtcaagatctctggtgcccgccggaatgaacttcggcaaaaagaaggtgctgacagacgaagaccttcccggagaaaaagaacgccaatcctttctcggtattgtcggcacactggacgaaaacgaaaaacgccagctgattcacgaagtgctctctccgctcggccataatctgatggtcacaccgaaggagattgacacctttattgatgatatggcgaacgtgcttgcaaacgggttaaacaccgcccttcatgaaaaagtgtcacaagataacaaaggttcttataatcattaaaatggttctacctcctctagcttgttcatagagtaattactagacaagcgctggagggattcaaatcatgagaaaaaaacgcagaaaccgtcaaattgtcgttgcagtaaacggtggaaatgcgctcaagggcatgtttttgtttatgacaagccttatcgttattttcgtattatcgggtgtgctcacatcgcttcgccctgaactgaggctttcttcgaattctcttcacggaattgccggagaacttccgggtgacgcgtttgcacacctcctcggtatggaaaatcattatttcgcctcagagcttcctgaaaaagactcttttcagctgtcccggctttccttaaaactggcgacaagcattaatatggaagacccgcggagtttcttgggacgtgagctgccgggatttgcccaatacgatacggagatccttctggcggggcaggggactgattatacgaatatgcctgctgaatccccgccgccgtcaaaggtgatggaaaaagaaaaagaagtgaacctggcagaaatcgaaaacaaaacgaaaaaagaagaaaaggcgccgccgaaacattcaacaggcagcaaaaaagtcgtttttatttaccacactcataataccgaatcctatcttcctctgttaaaaggggaaacaaatccggataacgcccgccattcgaaggccaatgtcacgcttgtcggagatatgttcggaaaagcgcttgaagcgcaaggtgtaggagcgaccgtagataaaaccgacattcaggcccgcctgaacaaagacggtttaaattatgcgcgaagctacgacgaatcaaggccggtcgtaaaaagcgcgctcgccaaaaataaaaacctgcaatataccatagacattcaccgggattcccgccgcaagaaaaatacgacagccgacatcaaaggaaaaagctatgccagggtcgccatcgtcgtcggcaaaaaaagcgctaattttgaagaaaactataaactcgcaagtgaacttcataagctgatggagaaaaaatacccaggcttaagcgtcggtgttttatcaaaaggctctccgggagataatggagtgtacaaccaggatttaaacgatcggtcgcttctgctggaattcgggggcgtggataacaatcttgaagaactgaggcgcgcatcagatgccgtggccgatgtattcagcgaactgtactgggatgcagacaaggtcagctcgcaatcaggagagaagaaaaaacaatagaaatcaggtgatgcaaatgatccgttttaccggcaaatgcctgctgatcgccattgtcatgtttgtcggcgtattgttcggcatgcagcaggcaaacagcggaatgcttgatatgaaaggatacaaagatccctccttaaaaggagcattcacgctcggcggcggagaaggacaggaaaaagaagcttccattttggggcaaaccgttacggcgaaagatctggaagaaaaacaaaaacagctggaacaggcagaaaccttcaacctgttttcaaaagccggagaaaccctttcaaataccgtgacggactcggcacaggcgatgtatgagtgggtttcgaaactgaaccgttagcattgatgaagagaaaagcggatgattccttaaaggaagcttttctctttcttgttttaattgaatgtttacaatcctattgatataatctaagctagtgtattttgcgtttaatagtaggagtgatagattgtgacagataaagaaaagcgtttagagaggcagtcaagaatccggaatttctccatcatcgcccacatagaccacggcaaatcgaccttggcggatcggattttagaaaaaacatcggcgatcacccagcgggaaatgaaagaacaattgcttgattcaatggaccttgaacgcgaacggggaattaccatcaaattaaattccgttcagctgaaatacaaagcaaaagacggagaagaatatatattccatctcatcgacacgcccggacacgtcgactttacatatgaagtttcgcgaagcctggctgcctgtgaaggcgcgattctcgttgttgatgcggctcagggaatagaagcgcagacattggcgaacgtctatctggcgcttgataatgatcttgagattcttcctgtcattaataaaatcgatcttccgagcgcagagccagaacgtgtgcgtcaagaggttgaggacgttatcggccttgacgcttcagacgccgtcctcgcttcagcgaaagcgggcatcggcatcgaagacattttagaacagatcgtagaaaaagtgccggctcccgcgggagatccggaagctccgctgaaagcgctcatctttgactcgctttatgacgcgtaccgcggagtcgtcgcgtatatcagagtcgtagaaggaacggtcaaaccgggccagaaaattaaaatgatggcaaccggaaaagagtttgaagtcatcgaagtcggcgtcttcacgccgaaagcgcagccggctgacgaattgacagtcggtgacgtaggctatttgacagccgcaatcaaaaacgtcggcgacacccgtgtcggtgatacgatcacgagcgcggttaagcctgcggcagaagcgcttccgggctaccgcaaactcaatccgatggtatactgcggactttatccgattgacacagccaaatataatgatttgcgcgaagctctggaaaaacttgaattgaacgattcatctcttcaatacgaggcagagacgtcacaagccctcggcttcggtttccgctgcggctttttaggaatgcttcacatggaaatcattcaagagcggattgaacgggaatttaaaattgaccttattacgaccgcgccgagcgttatttatgacgtttatatgacggacggcgaaaagatcatcgtggataacccgtcaaacatgcctgacccgcagaaaatagagcgggtggaagaaccttatgtcaaagcgacgatgatggtaccgaacgattacgtcggagcggttatggagctttgtcaggggaaacggggcaactttatcgatatgcagtacttagacgccaaccgagtcagcattgtatatgagatgcctcttgcggaaatcgtatatgaattttttgatcagctgaaatccagcacgaaagggtacgcctctttcgattacgagctgatcggctacaaaccgtccaaactcgtcaaaatggacattatgctgaatgcagaaaaaattgatgcgctgtcgtttatcgtgcaccgcgattacgcatacgagcgcgggaaagtcatcgtcgaaaaattgaaagaattgatcccccgccagcaattcgaagtgcccgtgcaggcagcgatcggacagaaaatcgtggcccgctcaaccattaaggccatgcggaaaaacgtccttgcaaaatgttacggaggagacatctcgcggaaacggaagcttcttgaaaaacaaaaagaaggaaaacgccggatgaagcaggtcggctcggtagaagtgccgcaggaagcgtttatggccgttcttaaaatggatgacagcccgaaaaaataacggaagccgccgcagtcccgcgctgcggcttctttctgtaaagaagaaggtgtttcaaaatgaaatcagcttatattcatattccgttttgtgagcatatctgccactattgcgatttcaataaatattttattcagagccagcctgtcgataagtacttaaactcactcgaaaaggaaatgataaatacaatagaacggacgggacgccctgatctccgcacgattttcatcgggggaggcacgccgacatcgctctcacccgcccagctggaaaaattgatggattccattcaccgcgtgctggagccttctgacggactcgtagaatttgccgcggaagcgaatccggatgatttgtccccggaaaaattaaaaatcatgaaaaatgccggtgtcaatcggctgagcttcggtgttcaaacctttgaaggtgagcttttacaaaaaatcggcagagtgcataaacaaaaggacgtattcacttcctttgaacgtgcgagggctctcggctttgacaacatcagtctcgatttgatgttcggcctgccgggtcagacgctggccgatcttgacaattccgtcaaaacggctttgtctcttgatgcggagcactattccgtttactcgctgatcgtagagccgaaaacggtgttttataatttaatgcaaaaaggccgcctgcatctcccggcgcaagaacaagaggccgagatgtatgaaacggtcatgaggcagatgagtgaagcgggcatccgtcaatatgaaatcagcaactttgcaaagcccggatacgagtcgcagcataatctgacgtattggagcaatgaagcgtatttcggttttggcgcaggcgctcacgggtatatcagcggcacgcgcaccgtcaacgccgggcctgtgaaacattacattcagctcatcgaagaaaagggactgccttaccgtgacacgcacgaggtgacacgggaggagcagattgaagaagaaatgttcctcggtctcagaaaaatgtccggcgtacaaaagcaagcttttctcgataaattcggacgctcggtcgacgaactgtttcccgatgttctcaaagatttaaccgaaaaaggcctgatctgtgacacggaagaatcggttgcattaacgcatgagggcaaattattaggaaatgaggtttttggcgcttttttgggtgagttataattgacatttttcttttggtttgttacttttgatatagaattagcactcgctgaccttgagtgctaacaggggtgatgatgatgttaacaaatcgtcagctgttgatcctgcaagtgattattaatgattttatacaatcagcgcagcctgtaggatcaagaactctttcaaaaaaagacgagattacattcagctctgcaacgatcagaaacgagatggctgacttggaggaattgggctttattgaaaaaacccattcatcctcaggacggattccgtcggaaaaagggtacaggtattatgtcgatcatttgctgtcacccgtcaagctgacaaaaaccgatctggatttaattcactcgatatttaaagaaaaaatcttcgagctggaaaaaacagtccaaaaatcagcgcaaatcctgtccgacctgacaaactacacatcgattgtcctcgggccgacgctgagcgagaactatcttaaacagattcaaatcgttccgatccagccggataaggcggtcgccatcctcgtcacgaacacggggcatgtcgaaaaccgcaccatcaatttcccggctaaagtggatttggccgatattgaaaaactggtcaatatattaaacgatcgattagcgggcgtgccgatggacgaactgaatgagcgcatttttaaagaggttgtcacatatttaaggcagcatatcgccaactatgacagcatacttgaatcgctccgctccacattccatccggcggcccacgttgagaaattgtttttcggcggaaagatcaacatgctgaatcagccggagttccacgatattgaaagggtccgctcgctcttatctttaattgaaaaagagcaggatgttctgaagctgtttcagtcatcaaaagccgggatttcaatcaaaatcgggaaagaaaacgactacgaagaaatggaaaactgcagcttaatcacggccacctatacagttgatacgaagcagatcggatcaatcgcgattatcgggccgacgcgcatgaattattcaagagtcgtcagcctgctgcagcacgtgacttcggacttgtcaaaagcattcacaagtttgtatgatgaataagggaattttggcaatcattttcagtcatctttttacagcatttgagggaggtgaacacaatgtcagaagaaaaacaaaccgcagaacaggttgaagcagcagaacaagaagaagtgacagaacaggcagaacaagcggcttcacaagagcagcatgaagaaacggcaggtcaggaagaagcccttcagcaccaaattgatgaattgcagggtttgcttgatgaaaaagaaaacaagcttttgcgtgttcaagcagactttgaaaactataaacgacgcagccgccttgaaatggaagctgctcagaaataccgttctcaaaacgtcgtaacggaaatccttccggctctcgacaactttgaacgggcgttacaggtagaagctgaaagcgagcagacaaaaagcttgctgcaaggtatggaaatggtccgccgccagctgatggacgcacttgaaaaagaaggtgttgaagccatcgaagctgtcggtcaggaatttgatccgaaccttcaccaagccgtcatgcaggtggaggatgaaaacttcggcagcaatattgttatcgaagaactgcaaaaaggctacaaactgaaggatcgcgtcatccgtccttcaatggtaaaagtgaatcaataactacatagcaggaggtaattcaaagtgagtaaagtaatcggaattgacttgggtacgacaaactcatgtgtggcagtgcttgaaggcggagagcctacagttatcgccaacgctgaaggaaaccgtacgactccgtcagtcgttgcatttaaaaacggcgagcgccaagtaggggaagtggcgaaacgccaatcaatcacaaatcctaacacaatcatgtctgtcaaacgccatatgggtactgactataaagtggaaatcgaaggaaaagactacacgcctcaagaagtgtcagctattatccttcagcatctgaaagcatacgctgaaagctacctcggcgaaacagtttcaaaagccgttatcacggttcctgcatacttcaacgatgcagagcgccaagcgacaaaagatgccggtaaaatcgccggtcttgaagtagagcgtattatcaacgaaccgactgcagcagcgcttgcatacggacttgataaaacggacgaagaccaaacgattcttgtttacgaccttggcggcggtacgtttgacgtatctgttcttgaacttggcgacggcgtgtttgaagtccgttcaactgccggtgacaaccgtcttggcggggacgactttgaccaagtcatcatcgatcatctcgtagcagaattcaaaaaagaaaacggcattgatctttcaaaagacaaaatggcgcttcagcgtttgaaagatgcggctgagaaagcgaaaaaagatctttccggcgtatcatctacacaaatttctttaccgtttatcacagcgggagaagcaggtcctcttcaccttgagctgacactgacccgcgctaaattcgaagagctttccgctcaccttgttgagcgcacaatggctcctgtccgtcaggctcttcaagatgcggatctttctgcgagcgaaatcgacaaagttatccttgtcggcggatcaacacgtattcctgccgtacaggaagcaatcaaaaaagaaacgggtaaagaagcgcataaaggcgtaaaccctgatgaagttgtagcgctgggtgcagcgattcaaggcggcgtcatcacgggagacgtaaaagacgttgttcttcttgacgttacaccgctttctctcggtattgaaacaatgggcggcgtgttcacgaaactgatcgaccgcaacacgacaattccgacgagcaagtctcaagtattctcaactgcagctgacaaccaaacggctgttgacattcacgtgcttcaaggtgagcgcccgatgtctgcggacaacaaaacgctcggccgcttccagcttactgatatcccgcctgcaccgcgcggcgtaccgcaaatcgaagtttctttcgatattgacaaaaacggtatcgtaaacgtaagagcgaaagacttaggcacaggaaaagaacaaaacattacaatcaaatcttcttcaggtctttctgatgatgagatcgaacgcatggtaaaagaagcggaagaaaacgctgacgctgatgcgaagagaaaagaagaaatcgaagtccgcaacgaagctgaccagcttgtgttccaaacggaaaagacattaaaagatctggaaggcaaagtggacgaagagcaagtgaaaaaagcaaacgacgcgaaagacgcgctgaaagccgctatcgagaaaaacgaaattgaagacatcaaagcgaaaaaagatgagcttcaaacaatcgttcaagagctttctatgaagctttatgaagaagcggcaaaagcgcagcaggctgaaggcgcagcaaacgctgaaggcaaaaaagcggacgacaacgttgtcgatgcggaatacgaagaagtaaaagacgacgaaacgaaaaaataagttctttcccgcatggctttaggcggaagaacacacagcatattctgattcaacagacagaaagtcaaagtcaggcatctcttggctttgactttttttcttgcccgggataaaaggaattgaaaaaacataattcaaaatgatacaatctaatttatgtgagaaattcgggagagtgaagcgagatgagtaagcgtgattactatgaagtgcttggggtaagtaagagcgcttcaaaggatgaaatcaaaaaagcctatcggaagctttcaaaaaaatatcatcctgatatcaataaagaatccggagcagatgaaaaattcaaagaggtaaaagaagcgtacgaagcgctctcagacgaccaaaaacgcgctcaatatgaccaattcggccatacagaccctaaccagggattcggcggcggtttcggaggcggcggagacttcggcggcttcggtttcgatgacatattctcaagcatcttcggaggcggcacgagacgccgtgacccgaatgcgccgcggcaaggcgcggatctgcagtatacaatgaccctgtcatttgaagacgcggctttcggaaaagaaacgatcattgaaattccgcgcgaagagaattgcgaaacatgtaaaggatcgggcgcaaagccgggaacaaagccggatacgtgctcgcactgcggaggttcaggccagctgaacgtcgaacagaacacgccgtttggcaaagtggttaaccgaagagtctgccaccactgtgaaggaacaggaaaaatcatcaaaaacaagtgttctgactgcggcggcacgggcaaagtgaaaaaacggaaaaaaatcaatgtcacgattcctgccggtgtggatgacggacagcagctgcgcgttccgggtcaaggtgaacctggcgtaaacggagggcctgcgggagatctgtttgtcgtattccatgtgcgcgcccacgagttctttgaacgcgacggagacgatatttattgcgaaatgccgttaacgtttgcccaagcggcactcggagacgaagtggaagtgccgacgcttcacggaaaagtgaaattgaaaatacctgccggcacacaaaccggcacgaaattcagattaagaggcaaaggcgttcagaacgtccggggctacggacaaggcgaccagcacattgtcgtccgcgtcgtcacaccgacgaatctgacagacaaacaaaaagacatcatccgcgagttcgctgaagtcagcggaaacctgccggatgaacaagaaatgagtttctttgacaaagtaaaacgcgcatttaaaggcgagtaatgattggataggagttggtagttttgaaatggtccgaaatcagcattcacacaacacatgaagcggtcgaacccatctcaaatattttgcatgaagctggtgcgagcggggttgtcatcgaagatccgcttgatttaatgaaagagcgtgagaatgtttacggggaaatctaccagctcgaccccaatgattaccccgatgagggtgtcattgtcaaagcgtatctgccgattaacagtttcctcggcgaaacggtggacggcattaaagagacgataaataatctgcttttgtacgacattgatttaggcagaaacacaatcaccatttctgaagttaatgaagaagaatgggcgacagcttggaaaaagtattatcatccggtgaaaatttctgaaaaattcacgatcgtacccacatgggaaacgtacacacccgtgaataccgatgaactgattatcgaaatggatccgggcatggcattcggaacgggaacgcatccgacaaccgttctgtgcattcaggcgcttgagcgtatcgttcaaaaaggcgaccgtgtcattgatgtcggcaccggttcaggaattttaagcatcgcggccgccatgcttgaggccgaatcggttcatgcgtatgaccttgatccggtcgctgttgaaagcgcgcgtctgaatctaaaattgaacaaagtgagtgatacggccgaagtgaagcagaacaatttgttagacggcatcacgggcgaacatgatgtcattgtcgcaaatattctggcggaagtgattctccgctttacatcacaggcgtatgacctgctcaaagacggaggccattttattacttcaggcattatcggccagaaaaaacaggaagtaaaagaagcgttggaaaaagccggctttaccatcacagaaattctgtctatggaagattgggtcagcatcatcgcgaaaaaataacagttagtaggtgtcacagcgtatgcaacgatattttatcgagctcacgaagcaggagatggacgaaactcccgattttcaaattacgggggaagacgtccaccatatagcgaacgtcatgagaatgagtgcgggagaccggataatctgctgttcgaaagacggccatgaagcgttatgcctgctcaaagcggtttctaaagatcatatatcatgcagcattgctgaatggacgggtgaaaaccgtgaactgccgttaaaaatcaggattgccagcggccttccgaaaggcgataagcttgaatggattatccaaaaagggaccgagctgggggctagtatgttcatcccctttcagggcgccagatccgtcgttaagctagacgacaaaaaggcaaagaaaaagcgggagagatgggcgaaaatcgcgaaggaagcggcggagcaatcgtaccgcaatgaaattcccgaagtgaaaaccgttcatacgttccggcagctgcttgaaatggcggagaatgtcgataaatgtgtcgttgcatacgaggagtcatcaaagcagggagaaacgggcgctttcgccgcggagcttaaaagccttccgcaaggttcgtctcttttaatcgtattcggccctgaaggcggtctgactgagtctgaagttcatcagctttcagaaaaaggcgccgtcttatgcggcctcggaccgagaattttacggactgaaactgcgcctctttacgcgttaagcgcagtttcctatcatacagagttattaagaggtgatcagtaatggcaactgttgcttttcatacccttggctgcaaggtcaatcattatgaaacagaagcaatctggcagctgtttaaagatgcgggttatgaacgaaaagaattcgaacagacagcagatgtatatgtcattaatacatgtacggtaacaaacacgggagataaaaaaagccgtcaagtcatcagacgggcgatccgccaaaatcctgacggcgtcatctgcgtaacagggtgctatgcgcaaacctctccggcagaaattatggccatcccgggtgttgacatcgtcgtcggcacgcaggatcgtgaaaaaatgctcggttacattgagcagtacagggaagagcgtcagccgatcaacggcgtcggcaatattatgaaagcacgcgtgtttgaagagctggatgttcccgcttttactgaccgcacaagagcgtcgttaaaaatccaagagggctgcaacaacttctgtacgttctgcattatcccttgggcgcgcggcctgcttcgttcccgcgatccggaagaagtcattaaacaggcgcagcagctggtggatgccggctataaagaaatcgtcctgacggggattcatacgggcggctacggcgaagatatgaaagattataatttcgccaagcttctccgcgagcttgatacacgtgtagaaggactgaagcggatcagaatttcatctattgaagcaagtcaaatcactgatgaagtgattgaagtgctggatgcgtctgataaaatcgtccgccaccttcatatcccgattcagtcaggatcaaacaccgttctgaaacggatgagacgcaaatatacgatggaatttttcgcggaccgtttaaataagctgaaagaagcgctgccgggtcttgccgtcacatctgatgtcatcgtcggtttcccgggtgaaacggaagaagaatttatggaaacataccggttcattaaagaacataagttttcagagcttcacgtattcccttacagcaaacgcaccggaacacctgcggccagaatggaagaccaggttgacgaaaacgtgaaaaacgaacgggtgcataagctgattgcgctgtctgaccagcttgccaaagaatacgcctccgattatgaaggagaggttctggaaatcattccggaagaggcgtttaaagagtctgatgaggacggcatgttcgtcggctatacggacaattacatgaaagtcgtcttcaaaggcacggaagatgtaatcggcaaacttgtcaaagtcaaaattcaaaaagcgggctatccgtataacgaaggacaattcgtccgcgtcgttgaggatgaaatgacccgaaacatgcgcatgtcttcataacagataaaaaaaccggtgccttcccgcatcggtttttttacggtttcggaggaatcagcctgtcaatcagccggtaaaacaaatgtgtgaacggcagaaacaataaggcggtgactacgttaaataacaggctgaaatgcgcaatcatctgcgcgggatcatcagacaggcgctccgtaatacctgctgatgcagacaggaagggaaagacgagcagcacgccgagaatattaaacactacgtgagcaccggcggtctgtctggcggcataaccgcctgaaacagcagccatgacggccgtgacgcatgtcccgatattagatcccagaacgacgctgaccgcttgttcaatgccgatcaccccttcgttcataaaactcatcaaaatgccgatgcagacggagcttgaatgaatgattgccgtcaatatcatgccgataaaaagagcggaccagctcgaatcattcacatggcgcaaaacctccgcccccgccttcatttctgtcagcggaacggcaagccggctgaagcatgtgatgcaaaaaaagatgatgccgagaccgaggaagcttataccgatctgcctgaacggatatttacggatgaggataaacacaaggcctccgataaaaagcacccaaatgagcacatccatctttatggctaaaaactccgtcgtaaacgtggagccgacattcgtgccgagaatcatcggaatggtccgtttaaaagataaagcgcctgcgctgacaaagccgatgacaatgaccatgaaggctgagctgctctgaagaaaaccggtgaatacgatgcttatgagaaaagctttcaaagggtggtcggtaaataagagcaggcttttctcaatttttgaatacgttaatgcgatcaggccctgcctgagcaggctcattccgagtaaaaaaaccaggataagtgcggtaaagagaatcagtattatcaaacgaaacacccctttccatcattatatagacaagcagccttattcatgacggaaaagtgagctcgcttagttgacctgactgatggcttatattataatgtcaaagtacatgtttatatatgtatctttttaaaggtagtcgattggtgtattcggagggagggaaagagaatgtcaaaaacggtcgttagaaaaaacgaatcgcttgaagatgctcttcgtcgcttcaaacgcagtgtatcaaagacaggtactttgcaagaagcaagaaagcgcgaattttatgaaaaacctagcgtaaagcgcaagaaaaagtcagaagctgctagaaaacgcaaattctaaaagagggtggatttatgagtcttcttgagcgacttaaccaagatatgaagctgtatatgaaaagccgtgagaaagacaaactgactgtcgttcgaatggtgaaagcttcacttcaaaacgaagcaattaagcttaagaaagacagtttgaccgaggatgaggaacttactgtcctatctcgtgaacttaagcaacgtaaagactccctccatgaattttcaaacgctgatcgtttagatttagtagataaagttcaaaaagagctggacattttagaaatttatttaccgaagcagctttctgaagaagagctgcagacaattgtaaatgaaaccatcgctgaagtcggtgcgagctccaaagcggacatgggcaaagtgatgagtgctattatgcctaaagtaaaaggtaaagctgacggcagtgtaattaacagacttgtcagcagtcaattatcttaattgacaagaaaaaagacatctttcctagagagatgtctttttttatacataaaaaaatgaaactaaagtacatttgttacgtatataaagaagaacgaaacgggaaggagggtatatttgccttgttccgaaaaaaaaacggaattgctgttgctctattgggcttatttgtattatctttattaggggttcaattgaacgcgaaagctgatcacccatcggtttatgtcatcccggttgagaaaaatgtcgaacaggggctcgcctcgtttttatcgcgttctttcaaagaagcgaaggagtccggcgcgtcacacattattcttgacatcaatacaccgggaggcgccgttcaatcagccttggatattgcggatatcatcggccgcgcggatgtgcctgttaccgcttacgttaataaacgggcgctttctgccggagcgtatatagcgcttcaggcagatgaaatctatatggcgccgggcggaaaaatgggtgccgcagccatcatcgacggaaaaggaaacgcggcggacaaaaaggctcaatcactgtggcatgcagaaatggaggacgcagcggttaaaaacaaccgaaatccgaaatacgccctggccatggcagatcccgccatcaatgcaaaggaagcgggcgccccaaagggaaaactgctgacactgacagctgaaaaagccaaggaagtcggatattcggagggcacggtttcagaccttgatgctttatatacaaagctcggttttgacaaagcggatgttcaccatgcaaaagaaggttttgtcggcaaattgggcagatggctgacaaatccgtttgttgtccccgtcttattaacgcttgctttgcttggtttgaccattgaattgttctcgccgggcctcggaataccgggtgccgtcggactgacggccatgctgctgtttttcaccgggcatatcgctgccggattcgccggctatgacagcgtattcttattttgcgcgggcttggtttttatccttttagagatatttctgcccggaggcataatcggtcttatcggtattgcaggcgtcatcgcgagcctctttctcgctgcgggcagctttaccgtaatggcggtttctctcttgatcgccattgctgtgtctattacagcctttatcatattaacaagggtgttggggaaacgaatgaaattctttaaaaaattaatattaactgattcaacaagcacggagagcggttatgtttcaaatcagaaccggacggagctgttggggaaagtcggcattaccgctacagccctcagaccgtcaggcaccgtcattattgatgatgaacgtctggatgtcgtctcggaaggatcattcactgaaaaagacagacaggtgaaagtagtgaaagcggaaggctcacgcattgtcgtgagagaaatatagatgataaccttgaggaggaattagatggaactgtcaagtttggcgattttagcaatagttgcagctgccataatcgtgttagccatattcttcacctttgtaccggtgatgctatggatttcggcgcttgcggcaggagtcagaatcagcattttcactttggtcggaatgaggctgcggcgcgtcataccaagccgcgttgtcaatccgttaattaaagcgcacaaagccggcctatccgcaacaacaaatcagctcgaaagccattatctggccggtggtaatgttgacagggtggtcaatgccctgattgcggcacagcgcgccaatattgagctgacatttgaacgctgcgcagccattgacctggccgggcgtgacgtattggaagccgtgcagatgagcgtcaatccgaaggtcattgaaacaccgtttatcgcgggtgtcgccatggacggaattgaagtaaaagcaaaagccagaatcaccgtaagagccaatatcgagcgccttgtcggaggagcgggagaagagacggttgtcgcccgtgtcggagaagggattgtctcgacaatcggttcctcgggtaatcataaaaaagtgcttgaaaaccctgatatgatttcgcagaccgtacttggcaaagggctggattcaggcaccgcctttgaaattctttcgattgacatcgccgacgttgatatcggcaaaaacatcggagcgattcttcaaacggatcaagcagaagcagacaaaaacattgcgcaggccaaagccgaagagcgccgcgccatggcggtcgcccaagagcaggaaatgcgcgctcgcgtagaagaaatgcgtgcaaaagtcgtggaagcagaagccgaagtgccgcttgcgatggcagaagcgctgcgtgaaggaaacatcggcgtcatggactatatgaacataaaaaatatcgacgcggatacggacatgagggattctatcggcaagctgacgaatgaccagcaagatgaagaccaacaataacctctctattaaggagggagccgctatatgcacgagattctgacaaatccgctcgtcattgccgccgtcatcggcattatatcggcaatattcggcaagaaaaacaaagatgaaaaacggccgccgggtacacgccccgaaaatcagacaaaaaagcaggatcaaaaacagccgcagaaagagcataagccggaagcggaagaattgcctgccgtttcagaagagaacccttttgagcaaaaaagaagggaagctgaaaagcgcctagcggagacggagcagatgtttaacgggcttgaacataagctgacatctcaacgcgcacgaaacgcgtctctgaagaaatcagccctcaaaataaataaagaaactgcggttcaaggcattatattcagtgaggttttgggtccgccccgtgcaaaaaaaccgcaccggaccatgcggagcatcggtaaaaaataaagtgttagaaccccttttcaaatcatacatatgagatgaaagggggttctttttttatggggcaaagaaagaatcgtgtaaaggcatggctgacaagagcattggaaattcccccggacgttatgatggatctgcctcggattacgatggtcggcagacttcatatctacatagagaatcacagaggcctcctgctgttcagcgaagaagaagtcaggctgatgctcaagcaggggcaatgtatcatatcaggaaaaaacttggtcattaaggcaatccttcctgaagaaattcttttggaaggcacgatagatcacgtacgatatgtcgattcataaagccggggggaaataatgtgaaaaacaaatggctgtcatttttttcgggtaaagtccaaatggaagtcaaaggaaaagggattgaacggttgctgaatgaatgcacgagaaacggaatcgccatctttgcggtgaaaaaaaagcaagactgtgttctgctgatgattcagcttcaagatgtacatgctttcagaagagtcatcagaaaacatgaatgcaaagcaagctttacaaaaagaaagggtcttccctttctgcttctcaaatcaaaattaaacctgggcttcactgcgggatttgtgatgtttttcgttatattgtttcttttgtccaacatgatttgggacattgatattaaaggggccaagcccgaaaccgagcatcagatggtaaagcaccttgaagaaatcggtgtgaaaaaaggacgtttgcaatttttaatgatgacgccggagaaaattcaaaaatcattaacaaacggcattgataatattacgtgggtcggtgtggaattgaacgggacagcccttcatatgaaagtggtcgaaaaaaacgaaccgacaaaagaaaagtacgtgagcccccgccatatcgttgccaaaaagaaggcggtcatcaaaaggatgttcgtgcaaaaggggcagccgatggcttttgtgaacgatcatgttgacaaaggacagcttctcgtctcaggactgatcggaaatgaagatcggaaagtcgcctcaaaagcggaaatttacggagaaacatggtacaagtcagaagtaaccgtgcctcttgaaacatcatttacgctatatacgggtaaagtaaggacgaagcacaagctgtctttcggatcatggggcgtgcctttttggggctttgaatttaatgaggagccgctgaaacatccgaaaacagaggaagaaaagcacccgtttcaatttctggggatgaagcttccgatttcttacgttcaagaacagacaagagaaagtgaaacaaccgtgcggacttatacgaaaggcgaagcggttcaggccggtatcaaaatgggaagacaagatgtagaaaagcgattaaacggcagcggagaggtggaaagtgaaaaagttttgcaccaatccgttgagaatggtaaagtaaagttgattattctctaccaagttatagaagatatcgttcaaaccacacctattgttcagggagactaaagaatggcagaacatttacttgcgattaatcacaaactgaaaagcccggacgaagcactttctttgttcggcagccaagatgcctttttacatttaatggagaaggatctgggcattagcctcatcacgcgcggtgaaaccatttacgtttccgggaatgatgaaacatttgagatcgctgacagattattgggctcgctccttactttaattcgcaaggggatcgagatttcggaacgtgatgtgctgtatgccgtgaaaatggcaaaaaaagatgaactggactattttgaaagcatgtatgaagaggaaataacgaaaacggcaaaaggcaaaccgatccgtgtcaaaaccctcggccaaagagaatatgtggcggcgatgaagaaaaacgacatggtgttcggcatcgggccggcgggaaccggcaaaacttatttggcggtcgtaaaagcggtgcatgctttaaaaaacggccacattaaaaaaatcattttaacaagacccgctgtggaagccggcgagagcctcggctttctgcccggagatttaaaggaaaaagtagatccttatctgcgcccgctgtatgacgcgctccatgatgtgctcggaagcgaccatacggagcgtcttatggaaagaggggttattgaaatcgccccgcttgcctatatgagagggcggacgcttgacgacgcgtatgtgattcttgatgaagcccagaataccactcccgctcaaatgaaaatgtttttgacgagattgggttttggctctaaaatgatcattacgggcgacgtaagccaaattgacctgccgaaaggcgtcacatcgggacttgcagtagcgaaggatatgctgaaggacataaacggcatctccgtgattgaacttgaccagacagatgtggtcaggcatccgcttgttgcaaaaattattgaagcttatgataagcaaaagtaatgcaaaaatgacccgatctcccgttatcgggtcatttttatatgatgtgttcctgatgtttcagggaggaggttcttgttttgaaaaagaaggaaaagggcaaaagcgcccgggaacggttccgcagtttcagacatgcccgctcagcccatgtgctgctgtacctgctgctttcagcgatcatgtttggtttgctctttattcatgtaaaacctgaatcacttaatttggatttgttttcagtcagtgataagacgatttacgcgcccgccacagtggaagatcagcaggcgacggaatcgaaaaaacaggcggccgaagatgcggtggaagatcaatacaccctgaaaaaaggctataccgacaaccggcttgacctgatcacttccatttttgacagcatcggcgaagtgaaaaaagatgcggaaaaagacaaaaagtcaccttcggaaaaatcattggtcaaatcggtgaaaaacaagctgacacaggatgtcaatgaatccgtctcggaagatgccattaaatcgcttctccatgcaaacaatgaagatttctcatttgtgagggattccgtcattaccgcggtgaatacggtgatgagcagtgaaattccttctgaaaagcttgccgaagcgaaggataaggtcgcaaaagagctgaaaagcgcttctgtgccgtcaaaatatttagcggctgcgactgaaatcggaaaatacgcggtcattccgaattacgtatttgatccgaaagcgacggatgaaaaacgccaggaagcgtcagacagcgtccagccggtacagatcaaacagggacaggttctcgtggaagagaatgacctgatcgaccgggaagtatacaggaagcttgaactgacggggcttttgaataattccaacctgttaaagccgatcagcggtctgcttctgatgatcgggctgtttatcgccacgcttgtctactattttgagaaacagcagcaggagcttaagctgaaaaataaatctcttttgctgttttctatcattacaacgcttattctcgtcattatggaagtcgtcagtctctttcagaagattgaatacaccaatatcggctatcttgtgccgatcgccgccggcgcgattttaatcaggctgctgctcaatgaaaggctcgccattttgggaagcatcattctggcgatctgcggcagtatgatgtttaatcagggtgtgacgggaacatttaattacgtcatcggcatttactatttaatcagcagcatttcaggcattctgtttttggggaaacacaatgcgagatcaaaaatattgcaggcgggactgttcgtctcatttattaatatgattatcgtgctgtcgcttttattaatacaaaatacggcgctgtcacctgttgaaatcggaacgctgatgctgatgggggtcgtctcgggacttgcttcatccgttttgattatcggtctgatgccgttttttgagacgggattcggcattctttcaacgatgaggctgattgaactgtctaatccgaatcatcccctgcttcgaaagattttaacggaaacacccggtacatatcatcacagcgtcatggtggcaaatctgtcggaagcggcttgtgaagccgtaggggcaaacggtcttttagcacgggtcggagcatattatcacgatctcggcaaaacgaaacgtccgcaatattttattgaaaatcagatgaatatggataatccgcatgacaagctgtctcctcagctcagtaaaaatatcattatcgcacatacgacagacggtgcgaatatgctcagaagctataagtttccgaaagagcttgtggatatcgcggagcagcatcacggaacgtcccttttaaaattcttttattataaagcgaaagaaaagggcgaccagattacagagaaagagttccgctacccggggccgaagccgcaatcgaaagaagcggctattatctcagtggccgacagcgttgaagccgccgtccgttccatgcataatcccaatcccgagcggatcgaaaaactggtgcggggaattatatccgataagcttcaggacggacaattctcagaatgtgatctcacgttccgagaactggatacgatcgccaaaacactatgtgcgactttaaaaggaattttccactcccggattgaatatccggaggctacgaagaaggtgaaataaatgggtttactcatagatattgttgatgaaacgaacagcgtctcagctgatgcgctccaagaagtggagaagctgctccaattcgcggcggaaaaagaaggcgttcaggatcaggctgaagtatcggtcacgattgtgacaaatgaagaaatcagagaaatcaacagagactaccggggaaaagacactccgactgacgtcatttcgtttgcgcttgaagaagaaggcgaagacgaggtggaaatcgtaggcgccgacatgccgcctgttttaggagatattatcatcagcgcagacagaacgaaagagcaggcggaagagtacggccattcgtttatgagagagctcggttttctggccgtgcacggctttttgcatttgcttggctatgatcacatgacaaaagaagaagaggaagaaatgttttcaaagcaaaaggatttgctggatgagtatggactcacgagatcataaaaacgagtggagcaggttcctgaagagctttgtccatgcatggaggggaatctggaaaacggcgcggtcagagcggaattttcaatttcatattaccgcggcctgcgccgttatcgtttgcggttttctcaccgggctgagcacagccgaatgggccgttgttttggtgctgatcggagggatgcttgctttggagcttttaaatacggcgatagagcatgttgtggatttagttactgatcagtatcacccgctcgcaaaagcggcaaaggacgcggccgccggagccgtttgcgtctttgccgtgatatcgtgtatcattggtttactcatcttcctgccgaagatatgttagcagaagattcttacaattattttacattgccaaaaatgggcgtgaaaaaccgatcataattatgtaaaataaaagtgacagcggtatcatacaggataaaggtaagagaggaattaagtacacatgaacagacaagaattgattgcagaagcattaaaagcacgggacacagcgtatgtgccgtattcaaatttcagagtgggagccgctcttcttaccaaagacggaaaagtgtacagaggctgcaacattgaaaatgcggcatacagcatgtgcaactgtgctgaacgcacggcgatattcaaagctgtttccgagggggatacggaatttgcgatgctcgccgtggctgcggatactccgggaccggtttcgccgtgcggagcctgcagacaagtaatttccgagctgtgctcaaaggatatgcttgttattctgaccaacttacaaggacaaataaaagaaatgactgcggaagaattattgccgggcgcattttcatcggaggatttacatgacgaacgaaagctttaaatcaggatttgtatctatcatcggaagaccgaacgtaggaaagtctacctttttaaacagggtcatcggtcaaaagatcgccatcatgagcgacaaaccccagacgacaagaaataaagtccaaggggtgctgacaaccggcacgtcgcagactatttttattgatacaccgggcattcacaaaccgaagcacaagcttggcgactttatgatgaaagtggcgcagaatacgctgaaagaagttgacttggtgttatttatgatcaacgccgaagaagggtacggaaagggcgacgagtttatcattgaaaagctcggacagacgtccacgccggtctttctgatcgtaaacaaaattgataagatccaccctgaccagctgcttcttttaattgatgagtaccgtgcgcgctatccgtttaaagaaatcgtgccgatctcagctttggaagggaacaacgtcgaaacccttctcgcgcaggttgaagcgtatttaccggaagggcctcaattctatccgagcgatcaggtgactgaccatcccgagcggttcattatttctgaactgatcagggaaaaggtgctccatctgacaagggaagaagtgccgcacagcatcgctgtcgctatcgagtccattaaagggcaggaaaacggctccgtccatgtcgccgccaccattgtagttgagcgggattctcaaaaaggcatcgtcatcgggaaaaaaggagcgcttctgaaagaagtcggcaaaagagcgcgggctgatattgaagcgctgctgggttcacgcgtttacctcgaattatgggtgaaagtgcagaaggactggcggaataaaatgtctcagctgcgtgatttcggcttcaaagaggatgaatattaattcatctaaagcgcatgcctgatgtgtgggattacctcacagaaacagggcttcgttagcaaaatttgtttaacatgaaaaggaggacatcaggtcaagataagggtaagaatttggattggcaagctagtttaatgatgaaaggtgggttttttgtgttgaattttacctggaacgtattttctcaaacaggaagtgttgatacgtaccttctttttaaagaactggaaaaagagaacctggaaagacccgaagaaccggaagatgagctagcccgaattgattttccaattttgtaaacctcttggcccctcccgttgttggaaggtgcggaaatgctgactaaatgtgaaggaatcgtgctccgtacgaatgactacggggagacgaataaaatcgtgacattgctgacgagggaacacggcaaaatcggcgtcatggcaaggggcgccaggaagtcagccagccggctgtcagcagtcagccagccgtttttgtacgggtcatttttaatgcaaagaacatccggactcggcacgctccagcagggtgaaatgattctcagcatgagaacgatcagagaagatttatttttgacggcgtatgccgcttttatcgctgaactcactgacaaaggaacggaagagaagaaaccgaacccctatttattcgaattgattctcgaatcctttaagaggctgaatgacgggactgacccggacgtgatcacattcatcgtgcagatgaaaatgctcggcgtcatggggctgtatccggagctgaatcattgtgtccactgcaaaagcggggaagggacgtttcatttttcgataagagataacggttttatctgccaccgctgctttgaaaaggatccgtacagagttccgatttcgccgcaaacggcaaggctgctaaggcttttttattactttgatatcggaaggctcggcagcgtctcgttaaaacaggaaaccaaaaacgaaattaaacaggtcattgatctgtattacgaggaatattcaggactttatttaaagtcaaaacggtttttagaccagatggaaagcatgaagaaccttttggatgaaaacaaaagttgacattctgcccatctttttatatgatcatttattataaaatatgttgcagtgacagaaagaagtacttgcgtccaactcatacaagcgaccttaggacagtgtaagctaaggatgagcgcgcaacgaaaggcattctcgagcaaccctttaaaaagaggctgagtgattcacatcctcagcaactagggtggaaccgcgggagaactctcgtccctatgtttgcggccggcaagcatagagacgggagttttttggttgccgccgcacttgtaaaagaatggagaaagtggaggtgcttgaaatgaacattcaagatatgattttaaccttgcagaagcactggtcgaatgaaggctgtgtgctcatgcagtcgtatgatgtggagaaaggcgcaggcacaatgagcccgtatacatttttacgaagcatcgggccggagccgtggagagtggcttacgttgagccgtccagacggcctgcggacggacggtacggtgaaaacccgaacaggctctatcagcatcaccaattccaagtcattattaagccgtcgcctgataacattcaagagctttaccttgattcattgcgtgcgctcggcattgacccgcttgaacatgatatccgtttcgtagaagacaactgggaaaacccgtctttaggctgtgcaggtctcggctgggaagtatggcttgacgggatggaaattactcagtttacatatttccagcaggtgggcggaattgaatgtaagccggtgtccgttgagatcacatatggtattgaacgtctcgcgtcatatattcaggataaagaaaacgtctttgatcttgaatggacgtcaggatttactgtgaaagatttatttatgatggctgaatatgagcattccgtttatacttttgaaacatctgacgtggatatgcttttccatttgttcagcacctatgaaaaagaagcgatcagacaaatggataacgggcttgtgcatccggcctatgattatgtgctgaaatgctctcacacatttaatctgcttgatgcaaaaggcgcgatctcggtgacagagcggacgggttatatcggccgtgtccgcaacttagcgagaaaagtggcaaaaacgtattatgaagaacgggaaaaattagggttcccaatgcttaaagaggagggctcttcccatgagtaaacaagacttgcttttagagatcggactcgaggaaatgccggcgcggtttttacatgacagcatggtgcagctcggtgaaaagctgaccggctggcttgctgaaaaaaatatcgcccacggcgaagtgaaactttttaatacgccgagacgtctggcagtatatataaaagacgtagcagaaaaacaggctgatattcaggaagaagcaaaaggccctgcgaaaaaaatcgctctggatgctgacggaaactggacaaaagccgctatcggattttcaaaaggccaaggcgccggagtggatgacctgtatataaaagatgtaaacggcacggaatatgtcttcgttcaaaaattccaggcgggacaagagacgaagacacttttaccgcaactggaaaatttgattgccggaatgcattttccgaaaaacatgcgctggggcacgcaggatctgcgctatatccgtccgatcaaatggattgccgccctctttggaaaagacgtcattccgtttgaaatcacaaatgtcaagacgggccggaacacgcagggacaccgctttctcggccaagaagtatctgttgatgcgccgtcatcatacgaaaagctgctgaaagaacaaagcgtcattgctgacccgaaagaacgcaaacaaatgatccaaagccagctggatgcgcttgcggccaagaagaaatggaacattccggtcgatgaggatctgctgaacgaagtcaaccatctggtggaatatccgacggcgctttacggatcttttgaatccgagtttctttctatccctgaagaagtgcttgtgacaacaatgaaagagcatcagcgctacttcccggtaaaagatgaaaacgggaatttgcttcctcattttattacggtgcgaaacgggaacagccatgcaattgaaaatgttgcccgcggaaacgagaaagtgctgagagcaaggctttcagatgctgcgttcttctacaaagaagaccaaaagctgaacattgatgaaaacgtgaagaaattggaaaatatcgttttccatgaagagctcggctcccttggagataaagtaagaagagcggtcaccattgcgggcaaacttgccgtccgcctgaaagcggatgaacagacgcaaaaacttgtgaagcgcgccgcagagatttctaaatttgacctggttacacatatgatctatgagttccctgagcttcaaggcgtgatgggagaaaaatatgcgcgcatgctcggtgaagatgatgccgtcgctgccgctgtcaatgagcactatatgccgagagcggccgggggagaagtgccttcaacctttatcggcgcggtcgtggcgttagctgataaactggacacgattgcttccttcttcagcattgacgtaattccgacaggttctcaggatccgtacggattgcgccgtcaggcaagcggcattgtttccattctgatcgaccgcaactggggcatttcttttaaagaactgctgtcgttgacagaaacggaaaaagagaatgagctccttgatttctttacacagcgtctgaaatacgtattaaacgctgaagacatccgtcatgacgttattgatgccgttctggacagcacagagcttgagccgtatgcagccgttcataaggcaagagtgcttgagaagcacctcggcacacccggctttaaagaaacggctgaatcactcggccgggttatctccatcagtaaaaaaggcgagagccgcgatatcaagccggatctgtttgaaaatgaacaggagaaaaagctgtttgacgcttatgaaaaaacaaaagacagtgtcgcggaaagctttgcctccaaaaactatgaacaggcgcttgccgtgctcagcggattaaaagagccgatcgaagattactttaatcacacgatggtaaatgcggacgatgaagcattaaaaaccaaccgtttagcgcaaatgaccgctcttgcagatgtgatcaagtcttttgctaatatgaatcatcttattgtaaaataaagaaaaagacggttgctgtgtgatcggcaatcgtcttttccccttttacataaacatcacagaatgaaaacatagataaagaaacccttccataaaggtggtgagtacgatcgaattaaataaacggcaagaacaaattttacagattgtaaaggaaaacggcccgattaccggagagcatatcgcagaacagctcaatttaacgagggccacgctgcggccggacttggccatactcaccatgtcaggcttcttagaggcccgtccgcgggtcggttatttttatacggggaaaacgggaaatcagctgcttgcggataaattgaaaaagctgcaagtgaaagattttcaatcgatccctgttgtcatcaatgaaaatgtctcggtatacgatgccatctgcaccatgtttttagaagatgtcggcacgttatttgtcgtagatcgtgatgctgtcttagtcggtgtgctgtcacgcaaagatttgctgcgggcgagcatcggccagcaggaacttgcctcaataccggttcatattatcatgacaagaatgccgaatatcgccgtctgccggcgtgatgattatgtgatggacatcgccaagtatttaattgaaaaacagatcgatgccctgcccgttattaaagatacggataaaggctttgaggtcatcggccggtttaccaaaacgaatatgactaagatacttgtcagtttatcagaaaatgaaatcatataagcttgaaaactaacggggggataacatggacaatcgcatcatttatgtagtatcagactcagtcggagaaaccgccgaactcgttgtaaaagcctcgctcagccagtttaacggctcagccgatgatacgcatatcagaagaataccttatgtggaagatatcggcaccattaatgaagtcgtgtctctcgccaaagcggacggcggcattatttgttttacgctcgttgttcctgaaatgcgcaaatacctggttgaacaagcggaaaaagcgaatgtgctgtattacgatattatcggtccgctcatcgataaaatggaatcggcttacggtttgaccgccaaatatgaaccgggccgcgtccggcagcttgatgaagattatttcaaaaaggtcgaggcgatcgagtttgccgtcaaatatgacgatggcagggatccaagaggcattttaaaagccgatatcatcctgctcggagtatccagaacgtctaaaaccccattatcacaatatcttgcccataagcgtctgaaagtggccaatgtgccgatcgttcctgaggtcgacccgccggaagaactgttcagcgttgatccgaaaaaatgcatcggcttaaaaatcagccctgataaactgaaccatatacgtaaagaacggttaaaatctctcggcttaaatgacaaagccatttacgccaatatcaacagaattaaagaagagctggagtattttgagaaaatcgtggaccggatcggctgccaagtcgttgacgtttcgaataaagcagtcgaagaaacagcgaacatcattcatcatctcaaaacaaagggccgataactcaggacgctttatcctgggtttttgggtatgcaaatagggaataaacaaaaaggatggcatcttcgcgaagtttgtattataataaaaaattgtgataaaatgtttatttttaggtttaagcttcgtgtgatacgaataaactattatgggtaagatgtcaagaataactcccggaaatttttcgacaaagctcaaaatagatccgcagtcatggagcatatgcgatttcgcttgtttttatgcaggagattgatggagggatggagaattagtcttctaaatgaaaaagaaaagacgatttttgtcgatgcagacgcatgccccgtaaaagaggaaataatgctcattgcatcgcaattcagcgttcgggttattttcgtcgcatcatttgaacactaccagctttccagaagcaaagacgagaactgggtatacgttgatcctcataaagaagcggcagatttatatatcgcaaaccatgtgagatcgggagacgtcgtagtcacgcaggatatcggtttagcatctcttttgctgaacagaaatattgccgtcttatcggaaaggggccgttcttatactgaagacacgattgacttcgctctgatgagccgtcatatgtcaggcaaaatgagaagaagcggcattcattccaaaggacctaaaaaattaaataaagaagatcggaatcgatttgttaccctgcttaaaaaaatcctgtcgaatgatgaagggatttcaaatcaaaacatcgaataatgtacgacggagtgttataagatgggaaaccgcataccagatgaagtagttaatcaggtgcagcagtcagcagacattgttgaagtcataggtgattatgtccaattgaaaaagcaaggccgcaactactttgggctctgtccgtttcacggggaaaacacgccctcgttttccgtctccagcgataagcagatctttcattgcttcggatgcggagcgggcgggaacgttttctctttcttacggcagatggaaggctattcatttacggaagctgtttctcaccttgcggataaatatcagattgatttccctgatgatataacgattcactctgcatccaggcctgaatcttccggagagcagaagatggaggaagcccacgagcttctgaagaaattttaccatcatttgctaataaatacaaaggaaggccaggaagcgttagattaccttttatcaaggggttttacgaaagagctcatagatgagtttgaaatcggctacgcgctggattcctgggatttcatgacgaaattcttgaaaaagcgcggttttgaggaagaaatgatggaaaaagcgggtctgctgatcagaagagaagacggcagcgggtattttgaccgtttcagaaacagaattatgtttcccattcatgatcaccacggagccgtggcggctttttcaggaagggcgctcggaagccagcagccgaagtatatgaacagcccggaaacgccgctgtttcataaatctaagctgctgtataactttcataaggcgcgcctgccgatcaggaaagaggagagagccgttctgtttgaaggcttcgctgacgtcatatccgccgtcagctcaggcgtaaaagaaagtatcgccacaatggggacgtcgctcaccgaagagcatgtgaaaatcctcagaagaaatgttcaggaggtcattctctgctacgattcggataaagccgggtacgaagctacgctgaaagcggccggcctgctccagaaagccgattgtaaggtaagagtaagcatgctgcctgacgggcttgatcctgatgattatatcagaacccggggcggagaaaaattccggaccgatatcattgatgcaagcgttacggtcatggcttttaaaatgcaatatttccgcaaagggaaaaacttatctgacgaaggagaccggctcgcttatatgaaagaagtgctgaaagaaatcagcgctctttccgggtcgcttgagcaggaaatgtatgtgaagcagctcgcctcagaattttctctttcggtagaatctttgacggaacagctttccatctacgccagacaaaacgcccccggcgacaaaaacgccgaaccgcagacaagacgggcccgggtgacgactaaagcgaaacggcgccgtctccgtcccgcctatgagaacgcggaaagacttctgctcgctcatatgctgagagaccgaaacgtcatcaagaaagtgattgagcgtgtcggctttgaatttaacattgacggacatcgtgcgctggcagcatacctgtacgctgtttatgaagagggtgctgacatgacgccgcagcatcttatggcgagaatgcaggatgaggaaatcagccagctgctttcagatatagggatgctccaagtaaacgaggagctctcagaggccgagttatccgattacgtaaaaaaagtgttggatcaccgaaaatggtcaatgataaaggaaaaagaagcagaaagagcggatgcggagaggcagaaagacttcgtgaaagctgcgtctctggctcaagaaattgttgcattgaaccgatcattaaagtaacaacaaatagaggcttgcgttctgattggcaatgattccttgcggaggagcaaatagatcgcttaacctcatcatgaattgtcattattatccgcagccctgcatgctgaaaaagagagaaggcttccgggtcggataagaaacataccgcttttagaattcgttgcaagctttggaaggagggatccataatggctgataaacaaacccacgaaacagaaacagaacttacattagaccaggtaaaagagcagcttactgaaactggaaaaaaacgtggcgttttaacatatgaagaaattgctgaacgcatgtccagctttgaaattgaatcagaccaaatggatgagtattatgaatttttaggagaacaaggtgttgaattaattagtgaaaatgaagaaacggaagatcctaatattcaacagcttgccaaagccgaagaagaatttgaccttaatgacctcagcgtaccgcctggcgtaaagatcaatgatccagtccgcatgtaccttaaggaaatcggacgggtaaatcttctttctgctaaagaagaaatcacctacgctcaaaaaattgaagagggtgacgaggaatctaaacgcagactggctgaagcaaaccttcgtttagttgtcagcattgctaaacggtatgtcggccgcggcatgcttttcttagacttgatccaagaaggaaacatgggtctcatgaaagccgtcgagaagtttgactaccgtaaaggatataaattcagtacgtatgcgacttggtggatcagacaggcgattacacgcgccatcgctgaccaggcgagaacaatccgtatcccggttcacatggtggaaaccattaataaattaatccgggtgcagcgtcagcttcttcaggatcttggcagagagccgacaccggaagagattgctgaagacatggatcttacgcctgaaaaagtccgtgaaatattaaaaattgctcaagagccagtttctttagaaacaccgatcggtgaagaagacgactcacatctcggtgattttatcgaagaccaggaagcgacatctccgtcggatcatgcggcatatgagcttttaaaagaacagctggaagatgtgctggatacgttgacagatcgtgaagaaaacgtgctgcgtctccgtttcggtctggatgacggacgcacaagaactttggaagaagtcggcaaagtgtttggagtaacgagagagcgtattcgccaaattgaagcaaaagcgcttcgcaaattgagacatccgagcagaagcaagcgtctgaaggattttctcgaatagaatggaacgggtctttttgatccgttcttttttatgtataagatatatggataatatacctttattttactggataagcatatgttttgcaaatgagtttggaaaaaatgcggcatgtcctgaaaggggggaaatgagacaagtttatttatattctttattgtaagcgtatacaattcattatacaatagaataaagataattttgtggtaagcaaaacagttatttttgctttttgtataaattgtgaaatcattgaaattgctgagcaagaccatttactttttgtaaaaataagttagaattagaagtgtttacatagggggagaatgaaaaagggggatggagatatgaagtggaatccgctgattccttttttgctcattgcagtgctgggaatagggctgactttctttttagctgtaaaaggcaatggagatgcgcatcagatcgcaagcggcggtgaaagcaaaaatgccgagaaggaaactgcaaacgcttcacctgaagagatttataaagccaactgcatcacctgtcacggagaaaactatgaaggtgtgtcagggccgaacttaaaaggcgtcggcaaaagaaaagatgtcgctgagattaaaacaaaaattgaaaaaggcggcaacgggatgcccgcgggccttgtgccggccgaaaagctggatgacatggcaaaatgggtttctgacattaaataaagctttaccggtccctatataaaagacatatgaaaaactctatccgccgcttggattccgggcggtttttttatatgatagtaaaggaaaaagaacctgagaaaagttgtgatattgtgaatgaaatgaagttatcgaaaagattgcagtctgtggcggaatatatccctccgggtgccctggttgctgatatcgggtcagaccacgcgtatcttccttgctatgccgttttgaatcatttggcaagccgggcaatcgccggtgaaattacagacggaccgtttctatccgccaaacagcaggtggaaaaactgcacttaagcactcttatctccgtaaggaaaggtgacgggctgagcgtccttgaaaaaggagaagccggcgccattacgatcgctggcatgggcggagcgctgatcgctcatattttggagtcgggaaaaacgaaattgacagggcgtgaacggctgattctgcagccgaatattcatgccgttcatataagagagtggctgtatcaggaaggctatgaactgcttgatgaagtgattctcgaagaagacggaaagtgttatgaaatcctcgttgcggaaactggcgaccgtgatgcgccttatcgggatgtgccgatggctgtcggaatgcttgcgggtccgtttttgttaaaagagaggaatgaagtgtttcttcggaaatggagccaggaacttaagcatactgaacaaatttatgaacagatcagccgcagcgcaaagcatgaaaatcatgaaaaattagctgaattgaaagagcggatttctctgctgaaggaggtaatcggacatgcctaaacatgtgaacggacaggaaatcatccagctgtttgaacaattttcaccgaaggcttatgcggtggaaggagataaaatcggactgcagatcggtacattgaataagccggtgaaaaatgtcatggtgacactggatgttttggaacaaacggtagatgaagccattgagaaaaaagttgacttaattatcgcccaccatccgccgatttttcggccgcttaaacagatcaccactgatcagccgggcggaagactgattgagaaatgtataaagcatgatattgccgtatatgcggctcatacgaatcttgatgtagcggacggcggtgttaacgatctgcttgccgaagctctcggcctgacagacactgaagtgctcgtcccgacatattcggacccgatgaaaaaacttgccgtatatgttccgaaagactatgaagaagctgtaagaaccgcactcggcaacgccggagcgggacatatcggcaattacagccattgcgcgttctcttctgagggaatcgggagctttaagccgctggacggggcagacccgtttatcggacagacgggagagctggaactcgtccatgaagtgagacttgagaccgtttttccggcaagtatggagaaaaccgtcgtaaaagcgctgaaaaaaagccatccgtatgaagaggtggcatatgatatttatccggtggagcagtctccgcttgaaaaaggcctcggccggatcggaaaacttcagcaggacatgacgcttgaagagtttgctctgtttgtgaaagaaaagtttgacgttaacggagtccggatggtcggagagcgaaacagcaaggtgaaaaaggtcgcggttcttggcggcgacggaaataaatatatttatcaggcaaagcggaaaggtgcagatgtttacgtgacgggcgacctttattttcatgtagcgcatgatgcgatgatgatgggattaaacgtcgtggacccggggcattatgctgaaaagatcatgagaaaaggcacggctgagaagcttacggcaatggccggagagaaaaactatgacgtgcgcattttcgcttccgaaacagatacaaacccatttaccttcttataaaaaaactgaggccccgggcctcagttttttatttttactttcggaagaatttttttgagcggcacactgtgttcaagctgccatgtcgattcatcgttgtggtcaaactgctctaaaaagcggatgacttcctttgtaatcggtgtcggtgttgatgcgcctgcggtaacggcgacggtattgacgtctttcagccattcgagcttcagttcactgatgtctccgattcggtaggcttttgttccggcgatttcttctgacacttgagccagcctgttggagttattgcttttcggatcgccgacaacaatggttaagtccgctttttttgcctgctctgatacagcttcttgacgaacctgtgtggccaggcagatttcctgatggtattccacgtgcgggtacttttctttgactgattccataatatcgtggacgtcccactgggacattgtcgtttggtttgtaacgattaatttctcagcctgaatatcgagatttctgacgtcttcttctgtttcaacgagatgaacgatttcaggagcgacgccgacggctccttcaggctcggggtggccttttttgccgatgtatatgacatgatagccttcagcttttacttttcggattaagtcatgtgttttcgtgacgtccgggcatgtggcatcaatcgtaacaagccctttttcctcagcggcttttcttacttccggagataccccgtgagccgtgaaaataacggttcctttttccacctgctttaaaatctccagacggtttgtgccgtcaagcgtgtaaatgccgtcttcctcaaacgcatctgtgacatgcttattatgaacaatcattccgagtatatatataggtcttggcagtgttttatcgagtgacgcgtttttggctatgaccatggcatcaacaacgccgtaacagtagccgcgcggcgatattttgataacgtccaatgtagatgtcctcctatcaaaagtgagtgtagaggcaatataaaaagccgtagttaaacggctcaaatcttgcattcttctgatctcattatagctaatctttcgtgagatatcaaagaatgttaaatatataatttcggctttgatctgcccgatgttctttttggacgcggctgttccgctgagtctgcctgtgcggcgtctttttcttttgaagcggatgctttttcagacgtcttctttgatgtgttggatgaggcgtctgatttgttttcatcttctgtttcatctgttttttcagcttcatcctttttatcctgttcgtttgtttcttttgtctcgtcagattcattctcatcatcgctgctgcttaattggctgtaaagcttcatcatggcgggcagactccgtactaaaggaccgtactgctgaatcatcggtgtaacctgctgcgccacgccgagcaccttctgaacgttgccgagcatgctcgacagggatgccggacttgccaggttctgtattccctgcagtcctgcacctgctcctccgctggccgccgccggtgccgacgcggcagcgcttcctcctcctgaaccgggtaaaaaacgggaaagcatcccttttaagccccctccgccgcccgtgcctgcgtttctcaggcccgctccggcaatctgctgctgagggaaaagctgccggccctgctgcatcagctgccggcccggcaatgacggtcttcctcccatcatcatacgcggattcatcaacggccggccctgctgcgccatatttctcatcggctgctgtggaaacatacttgtacctcctttctgtctctctgctattacaatatgcatcggagggggcatttgcttttctgtctcgaaaacaggattcccccaagacatggtgtttttaagtaaaatcggttataatgtgatgatggacacagaatgtgccgctttaaggagctgggaaaaatgaaagaaactaaatttgatggatacaacttaaaaccgtttattatagatgcagttcaccgccttggtttttatgaaccgacagatattcaaaagcggctgatacccgccgtgctgaaaaacgaaagcgtgatcgggcagtcccagacggggacggggaaaacccacgcctatttattgccaattttgaatcggattgatccgggttctgatacggtgcaggctgttatcacggcgccgacgagagagcttgccaatcagattcatcaggaagcgctcaaaatcacacagggtgcggaagatgagccgatccggacaaaatgtttcatcggagggacggacaagcaaaaatcaattgataagctgaaaacacagcctcatctcgtcgtcggaacgccgggccggatcgcggatctgattaaggcgcaggcattgaacgtctataaagcgcagtctctcgtcattgacgaagcagatctgatgcttgacatgggctttttagaagatgttgattatatcggatcgcggatgccggaagaacttcagatgcttgtgttctcagctacgattccggaaaagctgaagccgtttttgaaaaagtatatggaaaatccgaagtacgcgcatgttgagccgaaaagaatcacagccgaaaagattgaacatgttttggttccttctaaacagcgtgataaagacaagctgctttttgatatgatgtctcatctgaatccttatctgggcattgtgtttgccaatacgaaaaacacggctgaccatattgcgaaatacctgactgaaaagggcatgaggatcggtcttctgcatgggggattaacgccgcgtgagcgtaagaaggtaatgaagcagattaatgatctggaattcacttatgtcattgcgacagaccttgcggcaagaggaattgacattaaaggcgtaagccatgtcatcaactatgagcttccggacgatctggatttttatgttcaccgcgtcgggagaaccgcacgcgccggttcatcaggccaagcactgaccatttatgagctttctgacgaagatgcgctcgtaagactcgaaaagatgggtattgtgtttgactatgcggagcttgtaaacggcgaatggaagaaaggcgatgaccgccaccgccgcaaaaaacgcaaaaaatcggagaatgaggccgaccaaatggcgaagcgcctcgtgaaaaaaccgaaaaaagtgaagccgggctataaaaagaaaatgagctacgaaatggaaaagataaaaagaaagcagagaagaaacaaatctaacaaaggaaagtaggggactcgggttgctgaaaataggttcacacgtctcaatgagcggaaaacatatgctccttgccgcaagcaaggaagctgtttcgtacggggcgaatacatttatgatctatacgggcgctccccaaaacacgcgccgcaaaaaaattgaagacttgaatatcgaagcgggccgcgcccatatgaaggaaaacggcatcgatgagattgtcgtgcatgcgccgtacatcattaacatcggaaatactacaaatccggcaacgtttgagctgggtgttgattttctgcgttctgaaattgaaagaacggcagcaatcggcgcgaaacagatcgtgcttcatccgggagcgcatgtcggagccggggctgagacgggcatcaaaaaaatcattgaaggtttaaacgaagtgattgttcccggtcaaaacgtgcagattgcgctggaaacaatggcgggcaaaggatcagaatgcggaagaagctttgaagagctggccgagatcattgcgggggttacgcataatgaacatctatccgtctgctttgacacttgccacacccatgacgccgggtatgatgtcgccaatgattttgacggtgttcttaacgagtttgataaaatcgtcggcatcgatcggataaaagtccttcatgtgaatgacagtaaaaatattaaaggcgcccggaaagaccgccatgaaaatatcgggttcggagagatcggttttgacgctctgcagtacatcgttcatcacgagcagcttgccgatattccgaaaatcctcgaaacaccgtatgtaggcgaagacaagaaaaataagaagccgccgtaccgttttgaaatcgaaatgctgaaagaaaagcagtttgatcaggagcttcttgaaaaaatatcagctcaataaaaaaggagggggaattgccccctccttttttaccctgagaattggttgaaaagttcgtcaactttccgagctgtttcttttgaggttatcgtttctacttttttcagcaggcgaagccgctcctgttcatcaaaaatattgatgttttttccgtgcatcagagccgctacctcagccgcttgacttctcgtaatgctgattccgtattgcttggaatatttcagaagatcgtccgcagtgacttgattgagccgctgcaaaataattctttgtattaaaatcatcgatactttcacctctttagacataatgtattgagcaaatcattaaaatgttacggcttttaatggtaaaatgaagttgcttactgtttaaaatagttattacaggaaaggagattttatgaccccaaataaacagcataaaagagagtcatttttacactttatcttcagggtcattatgattctgatcggggcgggttcagccgctgtaagtattgaattgtttctggtccctaataattttatcgacggaggcattatcggtgtttcattaattttagaccacctctttatgtccaatcccctcctcaatttcgccttattcgttgtgttactcaacattccatttatgattttcggatataaatatatcggaaaaacatttctcatctctactgttatcggaattgtcggtttagcgctgattgaatcctccttgcaccatgtggaggccattacgacccagcctattttggcgacggtattcggcgggcttttgctcggtttcggggtaggccttgtcatccgaaacggaggctcgatggacggtactgaaatactcggtatccttctcacaaaaaagctgcccttctcagtcggagaattcgttatgctcatcaatgtgtttatttttatttgggccggttttgtgttcggtccggagcaggcgatgtattctttcatgacttattatattgccatgaaaacgattgacgccgtcatccaggggcttgatgaaacaaaagcggtcattattgtggcagatcagtatgcggaaatttcagacgcaatcttgcatcggcttggaaggggaaccaccaagcttcagggaaaaggcggatatacggatgaatccaaagaagtcatttacgcggtcgtgacaaggcttgaagtgactaaattgaaatccattgtgtttgaaattgataaaaacgcctttattacgatcatgaatacccatgaaacgaggggcggtaagttcaaaaccgcgattcactaggctttcatttacttttcatcattttataggtataatttgatacatcataagaaaatggcctgctgttcagacagctgccattttctttttggagcgataccgtgttgtaaaggggaggtcctcatgaacgtacaagaagcgttgaacctgctgaaagaaaaagggtataaatatacgagtaagcgagaagacatgctgcagctttttgctgattctgataaatatctgaccgccaaaaacgtgcttgccgcattaaatgacgactatccgggtctgagttttgataccatataccgaaatctttcgttatatgaagaactcggcattttggaaacgacggagctttccggagaaaaactgttccgttttacatgctcttatacccatcatcatcaccattttatctgtttaacctgcgggaaaacgaaggaaattgagtcctgtccgatggataagctgcacgatgatttggaagggtatgaaatcagcggccataagtttgaaatttacggcacctgtccggcgtgccgataaaaaacctcctgctatatacaggaggtttttttcagcttttaacatgctgaaagctgtgtttgtttttattaatccaggcgacggcttcaagccaattatgcaccctgataatattggaatcgatggggagctgattatatggggagttaaaaaggataaccggaatgcctgcttcttttgcgatcattgtcgcgttgccgtggtgatcttcgaaaaataaatcaatgccgtgttttttgacggcttccactttgtgatggcctccgacaagctcaatgtgatcgtaatgaatgtcccggtttgcaaaccagtccagcgtaacatcttctaagtggccgcgtcttgccgtaatgtagataagacggtgctcttctttcagtccgtccagtgcctgcttggcaaattccgcgagcttcgcttctttatatatggctgcttcatgaacgttcatccattcccaaaattcctcgtctgtaatgttcaaaagcttcgtcagatcataatcagtcatatcatccaaggtaatggaaagatgaaatgagcggtttaaataagggacaaatgtatcctgtgccgtaactgtgccgtcaatatctatacctaaccgtaacatgtccacactcctataaattcatcccttcaagtgtaacataaacaattaacaataccagaaaagtttagcaaacatgaatccgtaaaaaacgcggaaactaaaaaagctcctttcataaaagaaaaagggggaattgaaggtggcatacgattacgaaaatcgaaaaggcaacgactattacgtggatcatggatcggaaggaaccgatatcacgcgtgatgtttattcagaagaaacagcggccgaaatctcagagccatatcgtgcttctgaccgggcagcagaccgtgatgataatcgggacggagtaagtgaaggccgggggatagggtatgcagcattggctatttctatcatttccctgtttgtgctccctgttttattaggggcatgcggcattatcgtcggctatatcgccagaagaagaggagcaggcgctttaggcggatgggcgatgggaatcggtattgtttcccttgtgcttggcatcttcattacaccgtttttttaacacaacgcaaaaaaaaagcttggcggaatatccgtcaagctttttgtgtttcttgttctgcttttgctttttctgcttcaagctttgcatagtgttcttctgccagcttgtcgatttcttttttgagctcttcgaccattgtttcttcagggactttgcggacgatttggcctttgcggaaaagaagtccttcgccgcgtgcgccggcaatcccgatatcagcttctcttgcttcgcccggtccgttaacggcacatccgagaaccgctactttaatcggcgctttgactttagaaatgtattcttccacttcatttgcgatgctgatgagatcaatttcgatccgtccgcatgtcgggcatgaaataagcgtagccgcgtttgaagcaagaccgaatgatttcagcagttctctggctacttttacttcttcaacaggatcggcgctcagagagatccggagcgtgttaccgattcctttgcttaaaatcgctccgagtccggccgcgctttttaccgttccggcaaacagcgtgcccgattctgtaattccgaggtgaagcggataatcaaatgcttttgacgctttttcgtatgcttctatggcgagattgacgtcagacgctttcatactgacgatgatgtcatgaaagtcaaggtcttccaggattttgatatgatgaagcgcactctcaaccattccgtcagcagtcggatagccgtatttttctaaaatgcgcttttccaaagatcccgcgtttacgccgatccggatcggaattcctttttctttcgccgcttttacgacggcttccactttttcgcgacggccgatgtttcccggattgattctgattttgtcggccccgccctcaattgcttttaatgcaagcttgtagtcaaaatgaatatcgacaacgagagggatggaaatttgttttttgatgtcggcaatcgcgttagcggcgcgttcgtccggacatgccacccggacaatttggcagccggcttcggctaaacggttgatttccgcaactgttgcttctacgtcgtgtgttttggtcgtcgtcatactctgaatgacgacttcgttatttccgcctattgttaaaggtcccactttgacgggacgcgtttttgtacgatgtgtgatttcactcacttgtcaatcgctccttaattgtagttaccgcttttgcaggctgagccttttacatgtcaggcaacttctatttacatgttatattgtaacagtgtatttgccgaactgacaagaaattaacgtttaattgcggtagacggggaatttataagcggtgcctgcctgaatggcgtttgcttttacattcggattcagcgcttcaaaatcttgtgcaatatcatctggcgctttatgtgcgccgactatcgacatcaccgtatcgccttttttgaccgtaaccgttctgtatgaagcttcctgttgggctggctgtgccgccgctgcgtatgctggaaggtcttgagaagggatcgtgccgattttaagatcgtaaaagataatgaatatcacaaataaactgccgaatacaaaagtaagccgcttcattccaaccgcctcccgcatacatttttacttcattgtatgcttgtcccattttgttcatgacaaaaaagaagaccgccgggggcagtctttgttatacatctgttttacttcgcggtatctcttttaagacgaggaaaaggatgataaagtttacaaaccaattcactaaaaattcactcggcaccgtaataacaagcgcgcgcatgatcgtaaagaatacggtcgaaagtgtaatggaataagccgaaagcttccagagctgctggtaattcaatgtctttctttgcgcatttttcaatatcaggccgatgacggcgagaaatgatacttcaatgaatttgcctgccgctgtcatgatgaacagcaaaacggacaggacggtgacgatcattgttttattttggtttaatgctgatatgatttctttttttgtgatatcggcaggcatcagcgaataattcatttctgtcgcttgtccgtctacagcaagcaccattttatttttcaaaatgccgatcgcattttgtttcgccgctatttgtttcgcgccgtaagcatctgtgggatcaaagacgatgacgaacccgttcgcttccgtttccttagaggcggacgctttcgtctgcaattctccgtttgaaatgctgaaatcagggaaatctttctttaacacggttttgaaaccgttcattgagtttacggtgccggagcaaaggtaataagcgcttggcagcgtaaaaaggacagacagcaaaaatacataaaggatcgcttttcctatcccctgaaaccgtgtttttgcaatatctgccggagagtatgtacttttcaataaagccgtaaatatgttcaacatcttcacttcctagcctaaactggtatatgttgcttattgtatcgttcacaggggatgaacacaagtgagagtatttaaagcggtgataaggaatcatacataataagataaagcgggaagcggtgatcgcccgcaaaacaaaggagggtgtttttgtcatgagtgttttgtattggctgattatcattgcggtcttcatcattgcttttatcgggcttgtatatccggtgattccaagcgttatttttattgtggccggttttcttctctacggatttttgttttccttcagtccttattcttacctgttttggctcattgaggcggtatttgcggccgttttattcgcagctgattatgtgtcaaatttacttggcgttaaaaggtacggaggaagcagggcggcaatctggggaagcacgatcggattattgatcgggcccttcgttattcccgtggcaggcattatattagggccgtttatcggtgctgtctgcgctgaggtgtttgttcatcaaaaggatatcaagtccgcggcaaaagtggggctcggctcgttaatcggttttttaacaagcgtggcggcaaaaggcgtcattcagctctttatgatcggatatttcttatggacggtgctttagaaaggtttaatttcggcagggaacggataaagtgtaatatgtctgctggaatcgccggattgtgagctttttcattgattaccatgctttcttttgttacattgagattagaaaagttcgcgttaagcggcatttcagtacatatatttaaaggaggaaaaaaattatggcttacaaacttccagaattgccttacgcttatgatgctttagaacctcatatcgataaggaaacgatgacgattcatcatacgaagcaccataacacatacgtgacaaacctcaacaaagcgatcgaaggatcagcgcttgcagagaaatctgtagatgagcttgttgctgatttgaacgcagtgccggaggacatccgcacagctgtccgcaacaatggcggcggacatgccaaccactctttattctggactcttttatctccgaacggcggaggcgaaccgactggtgagcttgctgaagagatcaaaaacacgttcggaagcttcgatcaatttaaagaaaaattcgccgcagcagctgccggccgtttcggttcaggctgggcttggcttgttgtaaacaacggcaaacttgaaattacaagcacgccaaaccaagattcaccgctttcagagggtaaaacacctgtcctcggtcttgatgtttgggagcatgcgtactacctgaactaccaaaaccgccgtcctgattacatttcagctttctggaatgttgtgaactgggatgaagttgcccgtctttacagcgaagcaaaataaatagttcgatcaaacaaggtctcccgcgggaggccttgtttttttattgactttgaatccttttacatatctcagtttgagtgagacaaactaatgtgtagtaaaggggagtcaatgatgagcaaaataaaaaaaattatcggcgacatcgaaataaataaagggctgctgctgttattgacgattggcggcctttactcattgggcatcgcgctgtcaaatacatttgtcaacgtgtatttgtggaagcagtcgggaaaatttattgatttggccatatacaatttgtcggtcgtaacgatgcagccggttacctttctgctggccggccggctggctaaaaaaattgacagggtgtttattctcaggttcggcgttatctttttggccgctttttatttaagtgtgctgcttgctggagaaactgcggcttcccgtctcgttttgataggggccgtgctcggagttggatacggcttttactggctggcttttaatgtgctgacgttcgaaattacggaaccggaaacgagagatttttttaacgggtttttaggcattttgtcttcatcggcgggcatgatcggtccgattgtggccggatatgtcatttcaagacttgaaaacaatacgggttatacaatcattttcagcctgtcgctcggcttatttgcccttgccgtggtcatgagcttttttctgaagcggagggagtcgaaaggccggtttatgctgaaaaaagtttttgatgagcgccacacgaatctgaattggcgccggattaccaacgcgcacttttttcaaggcttgagagaagggatttttgtttttttaatcagcgtttttgtattcattgcgacaaacagtgagctggcgctcggaacattcggtctcgtcaattccgcggtttctttttttgcctattattttgcatcaaggctcatcaaaaaaagagctcggaaaaaggcgattcttatcggcggattgatcttgtacggtgccctgtttcttatcatttttaaaatgagcttcacgacgctccttttgtacggagtgtttattgcgatcggctatccagttctgctcgtgccgtatgtctcgcttacatatgatgtgataggccgggcgcggcttgccagaaaagccagaattgaatacattgtgctcagggagttatttttaaatgcgggcaggatcgtttccatcctttgtttccttgtaatcgttacattattcaaggaaaaagtgggaataccggcggcgctcgtgctgctcggagccggccatccgctgatttattactttataaaagacatcagactggatacggaaacttctgatgaaacagtagaagaagaccgacaaaaacaggcggcggaaccgaattttataaaaggagaaagataaaagggttatctgtagaaaaatatcgaaaaaacctttagaatgaaaaatgacacctgaacagaaggtgtcatttctttctgtaaataagaaaaggtgatgtcatgaggagaaataaaaagaaaatagctgtaaacaaagaaaagaaaaaatcactgccgatccggcttaattttttgtttttggccgcgtttcttattttcacttggattatcgtcgagcttggcatcaagcagatcgttcagggtgatgattataaaaacgccgctaataagcaggaggagtctgatgtcagcacggcggttccgagagggaaaatatacgaccggaacctaaatcccatcgtaacgaataaagcattaaatgcgattacatatacacgttcagcctcaaccacccaggcgcagcgtttaaaaatcgcaaaaaaactgtcgggtatgattaaggtaagcaccaaaaaggtgactgagcgggataaaaaagactattggatgttaacgaggcctgatgaagcgaaaaaactgattacggccgaagaaaagcaaaaagctgaagacaaaaaactgtctgaagatgatttatatcagcttcagctgaaacgtatcacagacaaacagctgaatgagctcacttcaaaagatatgcagatccttgcgatcaaaaggcagatggattcaggctactcactgacgcctcaatacatcaaaaatgaaggggtgtcggcaaaagaaatggccgtcgtcagcgaacatttagatgaactgccgggagttgacgtgacgtctgactgggaacggtcttatccttataaaagcctgatccggacattgctcggcagtgtatccagtgcgaacgaaggtcttccttccaatctgctggatcactatctgtcactcggctacagccggaatgacagggtcggaaaaagctatttagaatatcaatatgaaagcctgctgcagggtcaaaaagagaaagtgcagaacttaaccgactcatccggaaatgtcacgggcagcaaagtgatttcaaaaggacaggccggcaaagaccttgtattatccattgatatggacctgcagaaatccgttgaaaaaatcattgagaaaaatttaagatcggcaaaagcgagaccgagcacgaagcttcttgatcgggccttcgtcgtcatgatgaacccgaaaaacggagaagtgctgacgatggccggcaaacagattacgaatgatcatggaaagtacaaaattaatgattatgccctcggcgcaatgacttcctcctacgcaatgggatcggcggtcaaaggagcgacggtgttgaccggactgcagacgggcgcgattaatttgaacaccgttttccaggatgaacctatgtatttcaagggaagtaaaaacccgaaaaaatcatggaccaatttaggtcccgtagatatccaaaaagcgcttcaggaatcctcaaacgtgttcatgttcaaaacggcgattgctgtcggtaaaggggagtacaaaaaaggccagtcccttccgcttgatatgaaggcattcgatactttcagatactacttcaatcagttcggactcggagttaagactgggattgatcttccgaatgaagcaaccgggtaccaagggacacagcgaatttccggtcttctgttagactttgccatcgggcagtatgatacgtttacaccgctgcaaatggcgcagtatgtatcaacgatcgccaatggaggctatcgtttgaaacctcagcttgtaaaagaggtcagacagcctgattcgaaaaaaggaatcggagccgttgtagagtctgttcagccccaagtactgaacaagattgatatgaatcatgcagacattaaagaagtgcaggcaggtttcagacgtgtcatgacaaaagggacagccgcaactgattttgcgacggcgacatacagtcctgccggtaaaacgggtacggcgcaatctttctatgacggtcctgacaaatcagagacgggtgaaggaacgtataatacgactcttgtcgcgtatgcacctgctgataatccggaagtggctatttctgtagtcgttccttgggcctatattaattacagcgatcgatattcgattacgaatgatataggaagagcagctctggacaaatactttgagctgaaaaagaaacaagaagataataatacgaagcagaaaaacgaagataaaattcaggaagacgctgaaaacggcaatacaagcaactaacagaaaaacgctcacaacctgtgagcgttttttttatacaaaaaaacatccggatttacaaaaccttaacacttgatttatacgcattttacaagaaccctttactctatacgtgtaggacaaattacacattaaatgcagggggaattcaggaaatgaaaaaaaacaaatggatgcttatgcttctgatggctgctgttatgattgttgctgcagcatgcggaaatgcaaaggaaagcggcaagacagacagtcaatctgcaagtgaggataaaaaagcatcaggttctttaaccatttctggttcatcagccatgcagccgttagtactggcagcggcggaaaagtttatggaaaaacatccggatgctgatgtgcaggtgcaagcgggaggttcaggaacaggactttcgcaagtgtctgaaggggcagtgcaaatcggcaactcagatgtcttcgctgaagaaaaagaaggcattgatgcgaaagccctaaaagaccaccgagtagcggtagtggcgatggcggctgcggtcaaccccggtgcgggcgtaaaggatataaccaaaaaacagctgacagacgtctttacaggtaaaattaaaaactggaaagagcttggcggtaaagatcaaaaaattacactcgtgaaccgtcctgattcatctggaacacgcgctacgttcgtcaaatatgctcttgacggagcagagcctgcagagggcattacagaggattcctccaatacagtcaaaaaaatcattgcggaaacgccgggagcaatcggttatctggcattctcttatataaacgatgacaaagtaacgcctttatcgatcggaggcatcaaaccggaagagaaaaacgtcgtcacaggcgagtatccgatttgggcttacgagcactcttatacgaaaggtgaagcgtcaggccttacaaaaacgtttcttgactatatgaacagcgatgaagtacagaaaagtatcgtaaaagatcagggctacattccgatctctgatatgaaagtcacacgtgacgcaaacggcaagcaaagctgaggggagggcgggctccccgcctcttcttctttataggagtgtaaacaaatgataaatcacagagaaaaagagtctgtaagcgaacgcttaataagctcaaaacaaaacaggcaattggatgaagtccgcggaagggtgattgtgtctgtgtgtgccgcgattatcattgcggcatcagcggcgatcacaatttttctcggcataaaggggctgcaatctttttttgtaaatggtgtaagcccgattgagttcttaacaagtctgaattggaatccaacccaggcaaaacctgagttcggcgcgctgccttttattttcggatcatttgcggtcacgattctgtccgctctgatcgcagcgcccctcggtattgcgggtgccgtgtttatgacggaaattgcgccgacttggggaaaaaaggtgctgcagccggtaattgagctgcttgtcggcattccgtccgtcgtttatggattcataggtcttacagtattggttccgtttatcggctcttttaaatcaagcggaacgggtcacagccttctggcggggacgatcgtactctcggtaatgattctgccgactgttacatcgatttccgctgatgcgcttgcgtcacttccgaaacaccttcgcgacggttcatatgcgcttggggcgacgaggtggcagacaatcagaaaggtgcttatcccggcggcgtttccgacattgctgaccgctgtcgtgctcgggatggcaagagcgttcggagaagcactcgccgtacagatggttatcggaaatacaaagcttctgccggaaagcctgcttgatacggcgggaacattaacgacgattatcacgttaaacatgggccataccacatacggcagtattgaaaataatacgttatggtctatggggcttgttcttctcatcatgtcgtttctgtttatattgctcatacgctacttgtcatctaggaggaaagtgtaatgaaccggaaaataacggataaattggccaccggtgtattcgggttatgcgccgctgtaatcgcggcgattttggcaggattgtttttgtacattcttattcacggcgtctctgaaatctccttgcgttttcttacgtcaaaatcgagcgccattgcctcaggcggcggaatacgggatcagctttttaactccttttacattctgtttatcaccatgctgatcacgataccgcttggtgtggggggcggcgtctttatggctgaatatgcgccccaaaataaaatcaccgattttatcagaacgtgtattgaggtgctgtcttcgcttccgtccattgtcatcgggatgttcggcatgctgatgtttgtaaacctgaccggatggggctacacgattatcgggggcgcgctcgcattaacggtctttaaccttcccgttatggtccgggtgacagaaggcgcgctcactgcagtccctaaggagctgaaagaagcttctctcgctttaggcgtatcgagatggcataccgtcaaaacggtgctgattccgagtgcgattccttcaattttaaccggagccattctggcatcaggaagagtattcggagaagcggccgcattgttatttacagcggggctgacaacgccgcggctgaactttacggatttgaacccattttctgaatcatctcctttcaacattttcaggccggctgagacgctggcggttcatatatggagtgtcaatacgcagggaatcatccctgacgccgaagcgattgcaaacggcggctcggcggtgctggtgatttcggttctcttgtttaacctttctgcgagatggctcgggtctgtcatttataaaaagcttacggcaaattaatcggaaagaggcgaaaacatgatcgatcacatcatcagggaacaagcggaacagacaaagcgtttgccggagtcttcgattttggaagtgaagcatttatcaatttattacggtgacaaacaagcggtaaaagatgtaaacatgaatattgaaaaacatgcggtgacggctctgatcggtccgtcaggctgcgggaaatcaacatttttgagacagattaacagaatgaacgatgccattgcttcggcaagaagcgagggagagatcctttatgaagggctgaatattttgggtgaagcgattaatgtcgtgtctctcagacgggaaatcggtatggtgtttcaaaaaccgaatccgttcccgaaatccatttacaataacatcacacatgcgctgaagtatgcgggggaacgcaggaaagccgttttggatgaggcggtcgaggaaagcttaacgaaggcggcgctttgggatgaagtcaaagaccggcttcattcatcggctctgtcgttatcaggcggccagcagcagcgcctttgtatcgcccgtacgctggcgatgaaacctgccgtgcttcttttagatgaaccggcttcagctctggaccctatttcaaacgccagaatcgagacgcttttgacagaactgaaaaaagattattcgattattatcgttacgcataacatgcagcaggcgctgagggtgtctgaccgaacggctttctttttaaacggggaagtggtggaatacgggcagacagaacaaattttcacgagtcctaaagcgcaaaagacagatgactacattaacggaaagttcggatagggggaaggactgtgagtcttgtgaaggaagcggtgcacacacagaatttatttgatattcacggcatgaacgtatggtacggagcccatcaggctttaaaagacattacgatcggttttgaggagcggaaggtaactgcgatcatcggtccgtccggctgcgggaaatccacttttattaaaacattaaacttaatgctgcaaatggccccgaatgtcaaagtgacaggcgacatgatctataacgggcgcaatctgctgaaggaaaagacggatgcggcagaattaagaaaacagatcggtatggtgtttcaaaaaggcaatccgtttccccagtcaatatttgagaatgtcgtgtacggtccgagaattcacggcgaaaaaaataaaaagaaactgcttgaaatcgccgaggaatctttaaaagcagctgcgctctgggatgaagtgaaggatcgccttcaccaacaggcgctttcactgtcaggcggtcagcagcagcggctgtgcatcgcaagagcgctcgccaccaaaccggacgtccttctgatggatgaaccgacgtccgctcttgatcccgtgtccacgcggaaaatagaagagctgattttgacattgaaagaaaagtatacaatcgtcattgtgactcataacatgcagcaggctgcgagggtctctgatcaaaccgcgtttttctatatgggcgaactggtggagtggggcgatacgggcaaaatattttctcagccggatcatcaaaaaacacatgattatatcaccggaaaattcggatgaaaaaaacgggcccggccattaaccgggtccgttttatatgtctattaaaaaagcctgccggccgtatccatctgaatggacgatgcctgcaagcttttttagcgggttaatgttttgacgatttttttaaagctcatatctgaatcgactttgaaatggccggcgcggatttctttgtggtagcctgcgtcaatgacgtaatcattgaagtctttcgctgaaggaataatcccttctttttcaagaatggatgacacatcagcagtgctcattccgtctttaatcgtcagtttgtatgttacttttttctttttggcgtctgtgttttggtcgttgtttaacgatttttctttagaatcaagcagtttttgatagtcatcccggttgacggagactttatgctgatcgtcgaggtagctgtttacttctttttctgtcaatgctgttttttcggttttaacggcggctgcctggtcatggtcagtcaaatagaagacagcggcgagaacggccgtcgctaaaatcatgcctgctgcaaaagcctgaatgccccgttttgtcatacgagcaccttctcattatctttaataatggtattgacgtcctcgacagacacgtgctccgcttttgcgatggcttccgcagacattccgttgttatattttgaaatgatttgtttggcgattttttggtttatgccgctgcttttggctttgcggatcacgaggttggtttccagcaattcttcttcaagcaccgtcattttctttttcaacttgtaaatttcctgcatggcggaaagctgaagcgtttctagctcctgttccacgtctttcatcggatctctttgagaatatgagaatgcaataagcgctatactgacgataaacaacgcaataatagcaatttccacgtttcatcaccttctattattaatttgcccttcttttttataccataaaacgccgccattctaaaggaaatagagaaaaaaacggaattttgtcggaaaatcttttttactcggggagcaaacggttatttctctatagatttcgtatcagaaagcccttttttgtcctgtttcgtcatattttaccttcttctgacgcaagctcattcagaggatcagaagcgtaaactgatgttttctgcacttaaacaacatttcatgtaaatcagctctagcattccgtccattatagtggtattatatataagtctgaataagtaaatgatatttagtttggagggaaaataatgcgcgttaatattactttggcttgcactgaatgtggtgagcgtaactatatttctaaaaagaacaaacgcaacaatccggaccgcgttgaatttaaaaaatattgcccacgtgataaaaaatctacgttacaccgtgaaacaaaataagctgtttaacacagcggaaaaagctggagctttcaataaagttctggcttttttgtctttcagggaggtttgagaaacgtgaaagcacaaatcagaaccgatataaaagcaaagctttctgacatgacagaaagtgaatgggagaaaaaatgccgcagcatgcgtgaaacgctgttttctttaaaagaatggagacaggcccgcgtgatcgccgttaccatctcgacacgcctggaaattccgacacggccgattattgaacaggcctggcaagagaaaaaacaagtctgtatcccaaaatgctttccgcagacgggagcaatggagttccgtacattttctgcgtatgatcagctggaaaccgtatatgcgggcctcagcgaaccgatcgagagtctgacggaaaaagccgcccaaaatgacattgaccttgtgattgtgcccggcgtggcttttgaccgggaaggcttcagaatcggatacggcggaggatattatgatcggtacctgtccggttataaaggccgtaccgtgtcgcttctctttgactgccagctgacagaccgcattccccgcatgccccacgatattccggtcgatatgatcgtgactgaatctgaaaccatcgcttaatcgcataaaaaactttttgcaccggaataattctcgctgtttgacaaacgataggggcaggagggataagatgaaaaaattgttgatctactcattatgcgccgtatctgttttagccgtttaccaaaaccgctaccgtctgatgaacagcgtgctcagccagccggggatcagacggacattcattcatttctttttaaaaataccgtttatcagaaacaaattcattcagcaggcattttaaacaaatcccgttttttaagcgggattttttgcataagaaaacctgccggtaaaaaacggcaggttttctcgtattgtcagctttttttcaggaaaccgagcagaattgagattataggagaaatgtacaggaaaaaggtaaacggcaggtagtcgacgacggaaacccctaatgcgcttgccataaaagcgccgcttactccccagggaatcagcgggttgatcaaagttccgccgtcctcaagcgaccgcgcaaggtgaatccgcttaatgccgagcttgtcatataaaggtttataagattgacccggaattaagatcgacaaatactgctcacctgtcgcaaggtttacgcctatacttgagaagacggtcgccatgacaagacgtcctttcgtatgcacgccttttatcaatccttgaagcagcgccgcgatcaggcccgttttttccatcaggccgccgagcgcaaaggcgatcataatcagagagactgatcccatcatcgattggagcccgcctctgttgataatgctggccacagcctggtcgccggttttaaacgccgtcccgctttgcagggcggatataaatccttgaatgctgctgtcaggaataaaaacagcagtcagaagccctgcggaaataataccggcggtaagcaccggaatcacggaaacccgtctcacagctaaaatgatcactaacagaggtgaaagaagcgaccaaggcgtaacgtgcacggcctcttttattccggaaatgaccgcctcaatattttgcgttgaagcggcatttattgaaacagatgaaccgagaatataaaaaagaacgatcgtgatcagcagtgccggaacggtggtgcccatcatatggcgaatatgcttaaaaatcggaatttcgccgattccggcggcaaaattcgtcgtgtcggacatcggtgacattttatcaccgaaacaagctccgcaaataactgctcccgccgtccattcgagcggaactcccgccgcgcttgctacccctaacagcgcgacgccgattgtactgacagttgtcagacttgagccgacaagcgtgctgataatcatgcaggaaaataatgcggtcaaaagcagctgactcggctgtataattgacaaagcgtaaacggtgacggtgggaatggcgccgctgtacatccaggcgccgatcagcacaccgatcaaagccagcacgataatcggctgcaccccgttttttaatccgctgacaattcctttttcaagactctcccacgagaaaccgagccacaaacctgccagagacagaataatgacgcaaaagaacagcggcatatgcggctctgtatgaaagaaaaacaggcaggaaataatgactgctaacatcaagacaaataaactgatggctgagatgaacgtcagccttttttcttgtttcaaaacaacaccccatcaaactttaatccttttgtgcttttgggcacgaaagtattgtaacagaaaaacgcataaatgagtgtttttttacaattgtgaatatacaatttatgaaaataatacaaggatattttctccaatcgttttttgcttgacgcccggatcagtgatgaaatacgcttatactaagaagaatagaaatggtgaagaagatgaattcattttatgacgtgcagcagctgtttaagtcattcggacatattgtttatttcggtgacagacaagccgaaattgactttatgaaagatgaattaaaggaaatgtacttgtcaaacgtgattgaaagagatttatggcaaaaagccgccggagttcttcagagagaatcggagcggatcagaggcagttaacacagcaggattttaataagaaaaggagattattatggaagatacatggtttgcggggattgatctgggcggaacaaccatcaagctggcctttatcaacatgtacggtgaaattcagcataaatgggaagttccgaccgataaatccggaaacacaattacggtcacgatcgccaaagcgcttgatcagaagctggaagaactgaacaagccgaaacggattgtaaaatggatcggaatgggagcgcccggacctgtggaaatgacgacgggaatggtctatgagacgacaaatatggggtggaaaaactatccgctgaaagaccatctcgaggcggaaacgggtattccggccgtcattgaaaacgatgccaatatcgcggcgctcggagaaatgtggaagggtgcaggtgacggggccaaagatgtcattttagtgacgctcggaaccggagtcggcggaggcatcatcgtcaacggagaaatcgttcacggtaaaaacggggccggcggagaaatcggtcatatttgcagtattccggaaggaggagctccgtgcaattgcggaaaatccggctgcatcgaaacgattgcgtccgcaaccggcatcgtccgcatcgcgaaagaaaagcttgcggcggtttccgactcttcgctcttacaagtgcgcgatctgacggcacgtgacgtgttcgaagcggctaaacagcaggataagaccgcgcttgaagtcgtcgattatgtcgcaaaacatttaggcctcgtgctcggaaatctggcaagcgccatgaatccgacaaaaatcgtgctcggcggaggcgtgtctaaagcgggggaaatcctgcggtcaaaagtggaagagaccttcaaaatcaccgcgttcccgcgttctgcggaagcggccgatatttcgattgcggcacttggaaatgacgccggagtcatcggcggggcgtggattgccaaaaatgaatggctcaaacatcaaaactgctgaagaaagtctgcctgcccatatcgcgggcggctttctttttttatctcccctgtcatatagtttttaaaaaagggggatgaacatggcgggaattcgtgtcaaacctgaattgaaacagcatatgaaagatattgcaaaggtgctttcaattgatgaaaaactgttgaaagccgctgataaaacggcggaaagcgatgaattattttgtcccggctttgccgtgagcgggcagtcagagggtccgccgcttgagacgctgagcgggctttcgcgatacatccggcactgtgaaagcgttctttccgctgatcaatgggtgaaggaagaaaaggtgtacggctccgaatcggtttatgaagaaattgagaaaataacggatgtctttccgtttgtcacatgccgtaaaatcggcagttccgtattgggaaagccgctttatgagctgaaaataggtgcggatacggccgaaagaaaagtccatgtaaacgcctcatttcatgccaatgaatggatcaccacctcggtcgcgcttaaatggtgtaaagaatattccgtggcattatgcgaaaataaaaccgttttcgggcagtctgtgcttgatatattcagccggacatcattgtcattcgttccgctcgtaaatcccgacggtgttgatctcgtactttacggatgtgaagatttatcagaaaaaaaagaattcctcaacgaattaaatgagcaccgcccggatttccgcgaatggaaggcgaatataaacggtgtggatttaaataaacatttcccatccaattgggatattgaacaaaggcgcaaaccgaaagccccttcataccgtgattttccaggaacggcgccgctcactgaaccggaggcgcaggcgatgcaccggctgataacggaacagccacctgaccggctgatcgcgcttcatacgcagggagaagagatttactggggatacgaaggatgtgaaccggagcaatcatcccagatgattcgggagtttgaagcgataagcggaaaccgctatcaaggcgttaaaaccattgacagccatgccggttttagggattggtttatacagcagtatggaaaagagggctataccattgagctcgggaagggaaaaaaccctttgccttttcatcagtttgctgatatttatcaagcgacggaaggtattttgtggaggtcgcttgttttttgagacatctgtgaaatttctcatttgtttacataaacaaatatgggacaatagaaaagaatggagggaaggctgatgagatacttggtttgtgttctgctgtccgcattcgttctgtgtttagcggcctgtgaaccatctcatcagcagcaagacacaggcgtttcggcaaaatcggcagaacagaaaatcgttccgctcagtaaaaaggaagcggaaaaaacggaaggatggctggataacagaacaattctgtatacagcacatcatcagctgatgaaatatgatcttttcagcggaaaatccgaacggctctatgaaacaaagggcaatattgtcaatgtaaagatcagccggaaaaaacagctgattctcgtacaggtgacaagcagcggtcagactgagcttgtgcttatgaacaagcaggggaaaagactttatcacaaagcctttaactcttatgagctggagacggcttggaatccgtatgacccgtatcaaatgatgattaccgtttttactgaaacatgggacttcacagcctatacggccgatatgaacaacggcattttaaaaaagagtcccgttcaggccccttttgtccattggacctccactgatgaattccaatatatcaagcaaggaaaaacggaggaagagggtcctttatattcttatgacttgcagacgaaaaaagaaaaaagagtgcttcatcacgtcatctgggctgattcccgcccgggcatgacgattgccgtcagaccaacggatcaatcggacggagacggcgagttctttttccaaaagccggcatccgtgacacaccgctttcctctccaaaaaaagtatgagagcttcgcgccgatggaatatgattacgatcagacacacaagcggttttacatatttaagcctgaaggccgctcttacaatctgatcagctttgacttaggagacgaacgggagcggacggtgctcaaaaacacggaaatggagccgattcagatctctccgaacggggaatacgctttatacggctttacgtatgaccgtctgatttcactgaaaacgggcatgacagaaccaatcataacaaatgaaaaaggagtttgaaccaaatggcaattgcagatgtcacaatcattccgatcggaacaaaaacaccgagcgtcagtgagtatgtagcggatgtgcaaaaaattttggagggttacaaagctgccggcaaaatcaaatttcagctcacgccgatgaacacgttgattgaaggtgagctgagcgacttattcgcagtcattcaggatattcacgaagccccgttccaaaaagggctgcacagagtggcgacaaatatccgcattgatgacagacgtgataaagaaacgacgctggagagcaaaatcaaaagtgtcagcaaacatttgcagcaataaaaaataagcctgtatccattggatacaggcttttaatgtgcagtcggatagccgctggttacaacggtcattacggtaaaccagccaaacacgcccagcgtggcggcggctaacaaaaatcccaggatatttctctgtctgacagcccgcaggactcctaatacagctaataatgcgacaaggccgaagattacaacaagtaacatcatgctcctcctttgtcattggaacctgaaaatctttccatttcattttaaccgttttcattttgtttgtcgatagcgttttcccggccgcattcattgaatcttccgcagaaaaccttcataataagggcatatacataaagaggtgatgaaagtgaaatggagacgaatgccggccgggccgattcaggcaaacgcgtattttcttgtcagtgaggatcagtcctgtcttatttttgatccgggcggggaagcggacaaaatcaacaattacataaaagaaaacaatctgaagccgctggccatcttactgacgcacgctcattttgaccatatcggcgcacttgacgaagtaagagacagatgggatgttcccgtataccttcacaaaaatgaagaaaagtggctggaggactcttccttaaacggatcaggcatattgcggggcatcgccgtaacggcacggcccgccgaacggctcatcgaaggcgacggcattttggacatcgggcctttccatttggagacattgtttacgccgggacattcaccgggaagcgtttcttattatgtgaaggacgcggatctggtgatttcaggtgatgtgctctttcagggaggcatcggccgaactgatttacacggcggaagtcaggacgtattgcttgattccattcatcaaaaactgctcacgcttcccggacatacacttgtgttaagcgggcacgggccggaaacggacatccagacagagcaggagcgaaacccgtttatcaatggtttttcactgtaaatgaaaaaagacagaccataatcggtctgtctttttctgttcagtgggttccgccgcccggtgtcataataaaaatagagtagtatgtaaatccggcgaaaaatacggttaagtaagctccgaaaatataaatatacatccgctcagtcagattcaaataagaaagaaatacgaaaaagatcgtctgtccaaaaaacaaaagagaagcgtctttcatgccccctagaaaaaacatgactgcaaatatccccgtccaaaatcctaacacccggaacatgcgattcattccttatcccctcccgagagtctatctgaagtttattataatagatcggcactcaaaatgtaaacattttcatgattatatttattgtggaatttatgtctttccctgtgttttatatcttatgccgttctctaaaaaagatccgaaaaatctttttgaaatacgtttagggaaaaaaagttcagggtacttatgttaacaaagagacggattatccgagggaggaatttttaaaaatgaaagaacttattttttattcatacccgagctgcacatcatgccgaaaaacgaaacattggttaaaagcccacaatgttgactttcaagagcgacatctattcagggagacaccgacaattgatgaattgaaacagatcttatcattaacgaccgaaggaattgatgaaatattggcgacgagaagccaaacatttaaaaacctcaacctcaacattgaagaaatgactgtaaatgaagtgctgaagcttttgactgagaagccgaaactgctgcggcgtccgattctgatcgatcgcaataagctcgttatcggatacaatccgggagaactgatgaagctgacgaagaaaaaaacggtacatcaatctgtatcataagagaaaaacgaagatccgctgatcaaatttatcagctaatcttcgttttttgcggttgcgggactgggctagctggattcgaaccaacgatcacggagtcaaagtccattgccttaccgcttggctatagcccatcggatgtaattacagtatgtgcgtccggcgccgatttatacatacaaagtaatttgaatggaggagacccgtgaaacatttgaatgaaacattatctcgaaccttaattgaagaatcaggtgaaatcacacgccagtggctgctcataccaaaatcggggcggccttcagatgatcagaaagcggaaatgcagcaccgtctgttaattgaaatcgttgccggcattttatcggaaaaagaaggcggagaagaggagctgacaaagtgggcgcttcagttcgcaagggaccgggccgtccatgaagtaccggtctatgaaagcgtcacgagctttaaagaattccggagattggtctggaaccgtatacagacatgctgcgaaacgatgtctgagaagcccggggcgaatgcggtattccattggggagagaagctgaacaaagcaattgaccatatgattgaagtatttacagaggaatattataaagtgacggttacacaattaaacgcccaaaaggaaatgattaacgaactgagcgcgccgattatgccgattgccgccggtattggaattttgccgcttgtcggcgaaattgatacctaccgggcaaaaatgattttggaatcggtgcttgaccaatgttcttcactccggctttcttatttatttttagatatatcaggtgtgccgattgtggatacgatggtcgcttatcagattttcaaagtgattgacagcacaaaacttctcggcatagaaacgacaatctcaggcatcaggccggaaatcgcgcagaccgtcgtgaagctcggcatcgatttttctcaggtgaaaacggagcagagtctggcgaaggcgctggcaaaaaacggatttatcgtaaaagaatcattaagatgataaaaagctgaatggccgggagggatttctccctcagctattcagctttgtcagcttcaatcgtcatgatatgatggctgtcgatttcttttaccgtaaatgtgtagccttcaaaatcaatggtgctcccgggcttcgcgtcaatatgctgagtaagaaaccagccccccagtgtatcgacttgatcagccgtaatctctgttccgagtaaatcattgacgtcactgatcagcaatttggcgttcaggagatagcggttcttcccaagcttttgaacggaaggtgtttcgtccgtatcaaattcgtcgcggatttcgccgacgatctcttcaatgatatcttccgccgttactaaccccgcggttccgccgtattcatcaatgagaatggccatatgggcgtgttcccgctgcattttaacgaacaattgataaatcggaatcgtctcaatcacatggatcgccggctgaatgtaagggctgagttcgtgttttgtaaacgccgctccttctgacaggaatctgaataaaacttcttttatattgatgatgccgactacatgatctttatctccttttacgacgggataccgggtatatttatttgttttgataatgtcccggagcatatgtcccgatccgctgtctaacggcaggctcaccatttcattccggggcaccataatttctttggcagtgcgcttatcaaatgtaaaaatgttatttacgtaatgcagctcactttttttgatcatgccgcttcgatagctttcggcaaggagcacccgcaattcctcttccgtataagccatttcatgttcggaagcaggcttcaagccgaacatggctgtaatcaggcgggcggaatgattgagcagccagatgaacggaaacattaacttataaaacaaaatcatcggtctggcagacaaaagtgtaatccgctcggctttttggatagcaaaacttttcggggcgagttcgccgatgacgacattcacatatgtaaccagcagaaaggcgatgatcaatgacagtacttgggcaaccgcttcgtgaactccggtctttaaaaataacggctgaagcattgctttgactgtcggttcacccagccagccgatccccaaagcggtgacggtgatgcccaattggcacgccgataaatattcatcgaggtgtgtaatgacatgcttggctgcttttgctccttttacatcttcctcaatgagctgattaatacgggagcgccttgctttaacgattgaaaactctatggcgacaaaacacgccgttaataatataaatagtacgatggcggatagtttgatgatatacaatgtaacgccttccgcgaaggaaggcttgcacctcccttttttcggaataataccactgtagaaagctgctcaaacatcgaacctggtttagcccgcctcatttacggtaataaaacaagaaagcgatactggaggatgacaagagatgaaggtacattcgggtgcggactggctgtggtaccagctcggtccgcatgaaaaaacggaagcgaaaaaaatgatccatcacaatcactggccgcaatgcgaaaagtggtttgaacatgaaaatcatataaactttctgcgctcagatacaaatgatcagaataatgaagcggttttcggatctttaatctatcatcaaggattagatgatgaaaaaaaccataccgtatttcacttttatattacgagagacttcttttttacgattaattttgatttttcgctgctgcgcggtgtaaaagaaaagcatgccacacagcagattcaaacctgtgaaaatccgattgaaggcttttttgttctgctgggagagctgatgaattcctatctgatcggactggatgaatttgaagtcaagcagcggacgctgaaatggcagattcatgatgacaacagcaaaggaatcttggaaaatgtgcataaactgcgccatgagctgttcatttggaaaggccttacactgggggctaaaaaagtggaaatggctttaaaagaagcgtttcttccgaaaaatgacaggcagaaagattacctcagagctcatcataagatggaaagagggattacatatatcaatgagtttgatcaggaactgagcaatctgctgcacgccgaggaagtcattacctcccaaagaggaaatgaaattgtgaaagccttgacgatttttacaactctctttacaccgatgacggcgcttggagctctctgggggatgaactttgataacatgccggagcttcattggaaatatgcgtatatctgttccatcgtgctcattattgtatcaaccctgctgatttatatttatttgcggcagaaaggctggacaggggacattttgagggagcatcaaaaaaaatatttgcggaaagaaaagaaacgctaagaagagcaggcatacgcctgcttttttgatggctgaaaatggccgaatggttccggatttcattcagtaaatcaatgtcagggggcttattttttatttttttgcgttttacacagtgtaaaacgcataatctctcctttgccggcttttgtgtatctgatttacaatacgtgcggaaggagggaagtcttgtgaaaaatattgaaacatacagcaggaacatcataaacgaggcctatacggcaagggcttcagatatacacattgtgccgagagaaaaggatgctttcattcattttcgcatcggccatgctcttgtgaaaaaaagagtcttaaaaaaagaggaatgcgtaaggcttatttctcatttcaagtttttatcggccatggatataggagaaagacgtaagccgcaaaacggttcattgtctctgccgcttccgacggaaaccgttcatttgagaatgtcaaccttgccgacaatgaatgatgaaagtcttgtcatcaggcttttgcctaagcggcagattccccctctggataaactgtccttatttcggggggcgggcgccgcactattgtcctttctgaagcattcacacggcctgcttctgtttaccggcccgaccggctctggaaaaacgaccactctttactcgcttgtcaactatgcaaaacggcatttcaaccggcggattgtcacgcttgaagaccccgtagaaacaagagatgaggatgtgttgcaagttcaggtgaatgaaaaagccggagtcacatattccgccggtttaaaagcgattttaagacatgatcccgatatgatcatcttaggggaaatcagagatgccgaaacggctgaaatcgcagtccgcgcggccatgacgggacacctcgttctttcaagcctgcatacaagagatgctaagggcgccatatacaggctgctggagtttggggtgaacatgacagaaattgaacaaaccgtcattgccattgccgctcagcgtctggttgatttaacatgtccgttctgcaaagaggaaaactgttccgtgtactgccggatgtacaggcagacccgccgtgcgggcatttatgaactgctctacgggaaaaacctcacccaatgctttcaggaagcaaagggagagcacgccaattttcaatatcagacgctccgcaggctgatcagaaaaggaatcgcgctcggctatgtcacaaccgacaattacgatcggtgggtgtatcatgaagcggattaaacgaacctggccgttgaaggatcaagcggcttttttgaaaaggctcggtgaaatgacggaaaaaggatacagtctgattgaagggctcagactgctgaaactccagctgcataaacgtcagcttgcagagctgacggacggaatccgcaggctgagggaaggtgatgcgttttacgaagtgcttgaggcactgtcttttcataaagaagccgtctctatctgctatttcgcggagaaacacggagaattgccgggggcgatgaaacaaagcggcgatttgttacagagaaagctcatgcagacgaatcaaatcaaaaaaatgctccggtatccgatgtttttaatttcttccgtctgtgtcatgttttatatcctgcaaagtttaattattccgcagttttctgggatttatcaatcaatgaatatgaatacatccggtgcgactgctttcatctttgcattttttcggcattttcatgaagcctgcgcactggcgctgtccgccgctttctgcttgtttttgtacgtttggttcttatgtaagaaaaaatccccgcaagataaaatgctcattgttgtgaaaatacccctcttgggaaaagcggccgttctttttaacagctactttttctctttacagctcagcagtcttctgaaatccggcctttctatctatgacagcttaacagcttttaaagaacaatcttttctgcctttttatcgtgaagaagcagagatgctcattacacgtctgaaagccggagaaaccatagaatccgctctttccgggcatccgtgttatgaaaaagatcttgcggctgcagtcagccacggacaggcaaacggcctgcttcaccgcgaactttatacgtacagccagtttatgatggagcgtcttgaacaaaacgcggcgaagtataccggcattctccagcctgtcatttacggtgttgtggccggtatgattttaattgtctacatgtcaatgctgatgccgatgtaccagatgatgaaccaaatgtaagggagtgcttcgtctgaaaaatcaagatgggtttactttaattgaaatgctgatcgttttatttatcgtttccattctgcttttaatcaccattcctaacgttacaaaacataatcaaagcattcagcataaaggctgtgaaggactgcagaatatggtgaaagcccaagtgacggcgtacgaaatcgaccatgaaggtaaaatgccggatatgaacgatttacaatcagaggggtatatcaaaaagaatacagcctgcccgaatggtaaacagatcttaattagtggcggagaagttacagttgaacaataacaggcggacagaaaacgggtttacccttcttgaaagcctgattgtgttaagcctggcgtccgtcctgctgacggttttgttcacgacggttccgccggtctgcacccaccttgccgtgcggcaaaaaacagaacagcttcaaaaagatattcagcttgcgcaggaaacggctatcgcagaacataaaagaacaaaaatcacttttcttccaagagagcataaatacaaactgcagtcagccggaaggattgtcgagcgttcttttgattcgcttcacattacacttgtgactttaccggagagccttgaatttaacgaaaaaggccatccgaattcgggaggaaagattcgattgaagagcgccgggttcacctatgagatcacagtttacttagggagcggaaatgtccatgctaaacggaaataaagggttctctactattgaaacactatcagcaatggccatttggctgttccttatgacgtctatcattccggtctggacaggcatgctgacagatggtctgaaaatagaagatcgccaggaagcgtatcagcttcttcagaaacatatcagcacttatatgatgaccggaaaaaagccgccgtctcccggtgtgaagtggaagggggatggtgagtattacaaagtgtgtgcggctgaccgcggcgaaaaagaaatgtgcctcagcattctcaaaacagactggctttacgcttcttaatgttttgttctccttggcagtctgtcttttcctatcaggcaccctgggcccgattttacatctgtttttatcaaaccggaccgataacggcggattagacagccgggagcatcaaattgccgttcagcagatcatgaacgaatgtaaacaggctgagactgtgaagccggcggacggcggattggcgttagcatgccggaaaacagggggcgaagaagtgcgttttgaaatttatcataagatgataaggaaaagagtaaacggaaaaggccacgtgccgatcctgcaaaacgcggcatcattaacggctgatgtgaaaaacggcctgctcttattagagatctcaagcgttacaggtaaaaagaatcaggcggtcattccggtttacagctctttaaaaggtgattaaatgtacaaatctgacggttttatctatcccgcggttctgtttgtttctgccgcagttttacttgtcatcagctatacttcatctgatttcatcacccgaaaaacatttgcgaaagaggccggggagtactggatcggagagaatctgctccaaaacggcgcgctgctgtcaagccgccatatgacacagggacaaaaggtccaaactggtacacagcgttttccgtacggaactgtttccttccgcatcaccgggagtaatcgccgggaaacggttcaggttacaattcaggccgaaacagtgtcaggcacgagacgggaggctcaccttttgttcgatcagaagaagaaacagctgattcaatggacggaagtataaaaaagaggcggcgggacaacacttcatagtaaagacagcactatgaggtgagagccgtgaaaacaaatgattatgtaaaatatatgactgagcaattcgttaaatatttcgatacgccgaaacaggaacggagagagcgaaaagaagtgcggaaagaaaagaaagtgccggcttctcagcactggttcggaatattgccgtacagttttaagctgtggatgcagcggaaaaaataaagcgaatcacacataaggtcctcctgtatcaggagggccttattggtattcctcaatgacggcaattttatttaccttttggctgtagggattaaaagaaatcgtaacaaacacaccaaattcttttgcgccatcccgcaatgtcaagtggtattgtttgactgcttcgtccgttcttttccggtcccacaccttttgaataaataacgtttgggcgagcggatatctttttttagcttctttttctgctaacttttcccattttgatttatggtgaacagcataataaggcaccgtttccgcctgagctgttcctgaaaccccgaaaacaagaagagaaaggcaaatcagactttgtgtgatcatcattcttcgtcctttcgctgtatatactttccattttgtgctaggcacctcgttattttctcacgttttattagaaaaaattccaaaaaggtgtgtaatttgaagcaaaacgatgtttttgaaagataccattctcaaaaacgaacaaattgaccgattttgacatttttcaagacgataatccttgattatactttgttcatgaagttctttaaagagaacggttgtcatatttattaacagttttacagggggtaaggcatgttccgattgttgcgaatggaaaaaaagggcaaggtgagatggcggatgatgctatttttacggctttcgttcattttttgcctgtccgtgacgatatgtgctcagttcacaggtgatacaagttcctccttcaatgatgtgaaaagcttcagtctcccggttcaaacgtgcggagattttcaatatacggatgacgattgccgttatgacgaacgctgggatcagagtgatttacatataacaaatcaaactgatacgtcaggcaccgtgtgtgcgccgcttcaactctatgccgagctggagaataagggaaaagagcggactgtttctgactggaaatgggagctccataaaatcacttctcagcagcagcctttacgaaacggcaatgttgtggataaagggcttattactgataaaaaaagcaaaacgatttataaaattgagtcaaagcggtctttgcagccgggcatatacgcattcaagatttacaagcctgaagggtatccggcggacgaagaacaatttgagtggtcaaaaccgatgaaactcgtcaaatgccgggaacaggcaaccgtttccgatctgaagaaaacggagaaagagccggctgagccggtaaaagaaagcggggaagaacatgaaaaaaacgctgaaactgatcagtaatattttgtatgccgtcatcttcagcctgattattgtgctgacgttaacggtgatttcgacccgggcttccgggggtgagccggccatcttcggctatacgctgaaatccgtgctgtcgggttcaatggacccggaatttaagacgggttcgctcatagcggtaaagaaaatttctgacgtaaatgacttaaaaaaaggggatgtgatcacctttacgcaagatgacggaacagccgtcacacacagaataatcgggatcacaaaaaaggacgggaacctgctgtttgagacaaaaggggaccataatgccgccccggatgccgcccccgttcaagctgaaaaagtggcggcccagtatacgggatatcagcttccgtatgcgggatatgtcatacatttggcaagccagccgatcggaacggcgattctgttaatcgttcccggcgtcatgcttttgatttactcaataacagtcatcgtcagcgccctccgcgatattgagcggaaaacgaaagcgctggaagaacatgcgaaaaagagaaccatctccacatgaatacggttgcaacctggcgacaggatttgataacaaaaaataaaaagtaaggggagtacaaacatgggtatgaaaaagaaattaagcttgggcgttgcctctgccgcactcggtttagcattagtaggaggaggcacatgggccgcatttaatgatgtgaagtcgacggacgctacatttgcgtcaggaacacttgatttatcggctaaagaacaatcagccaatgtcaatttgtcaaacttaaaaccaggtgataaattgacgaaagattttgaattcagaaacaacggttcacttgccattaaagaagtgctgatggctttgaattttactgactttaaaggagcaaagaaaggcaatgaatctgcggaggatttcctcagccagtttgaaattacggttctgacagtcggtaaagaagggggcaacggctatcctaaaaatatcattttaaaggcggccagcctgaaagacttatacttaatgtcaacaaagcaggataaagcagctgccgaagcgatcagcaagcacattgatccgaaattcctgagcgagagcggaaaagtcaatgtggcaaccattaacggcaaaacagctcctgagtacgacggagttccgaaaacgcctgctgattatgaccaggtgagaatggaaatccaatttaaaaatgacaccgcaaaaactgcggacggattaagtgtgcaaaacaagttccaaggcaatgcgatttctcttcaattctcttttgaagccacgcaatggaacggcttgaccattaagaaagatcatacggataaagacggttacgtcaaagaaaatgaaaaggctcacagtgaggataaaaactaatccgaaagtcggacagttaaaagaggagttgtgcacatatggcggcactactcctctttttgcgcttttctccatttttgataatctaaaaattcacgaaattgtttttttgataccccggatgtcatcgcatcgcgaactaatttctcccattcactatctaattgaccatcgtattcggtttcatgtttttcatcaagtaaagtatgaaccgagacgtccagaacagcggagactttttcgagaaattgaatggaggggttcgtctgtaaatttcgttctattgagcttaaataagacttcgctaccccagctttttcagctagttctgatagtgagtagcctttttcttttcggtattgtttaatacgctggccaatcaatgtcatcaccttccttgtgatattatagcacattcagaaaggatttacggtatgacttctggctgcctggatatgttgagaagactttttatgcgaaagcaggtatttgcgtatttcttctaggctgatatttgctttttgggcttctaatatcagctcaacccattccttatctaattgcgaaaattccatttttgcatttttcatgcattttctcctcctaaaatacttgtttatgtatttcagccaatccgcccatgaccttatctttacatgtctggaagtgattcatcgcatgcgaaacgccagaaattttttctatatacttttattataatatagaatttccagaaaaaacgggaaaggtgtcgaatggataacgcttatccagaaaaattactttgcaggaaaaataaaccgccgttttcaatctgaatgtgaattttcggctgatataaggctttcagcgcttgtttttccaaatggtattcctcaggtttttcttctgtctgctcataaaactgatcgagcagcctgaggtcctttttccatctggcgatcgcgctgtcagcccagtctgacggctctttggcggcagcgtcttttaagtaatgctccatccttttaatcccgctttccggcttaatcatcggcgatatggtaaagcaatagtctgatatttgcgaggtcagcggaagcggtgcaagcttctgctgaaacccttctataattgttccagaaacaagatgcaggcctaaagacaaaagtctgtcttttttcatgtcggattggtatgaaatcactacatttaatccaagccagggctgaagcggcactctggctccggctgatacaattttctcatatattcttgtaaatctcccattttgtttaactgcttgaaagatttgaaagaggcgcggggctccaaagtaaataaactcgccgtccatatcctccggagccgtttctttatcagtgatgaacgtaatcttcatcgggttcggttcgccgcccgttttttcacgccaatgccaataaaacgggcggttcataatttgtttgtccatctcgaccgtcaactgaaccgtcataaaacccggcccgtgttctgtaatcgggcagtggttcgcttcaaaaaagcgcagtaaaaattggtgaacctcctgctgtctcatgtcgcgcttcctcctttttaagagcctttttttctggcgggcttttccgtaccgtacgacagaaaagaggtgagattgtccattttgattctcatttcctcctctgtcagcgaatggcataaaatatcatgcaaatggtcttcaaaattgctcactttgatttttgttaaaatgtcatctaattctccgacgacattttcaaataaatgaattttgtcatacagaagttttaagatatgctcttccaccgtatgttttgtcgccatattgtagatatggacatctctttcctgaccgagtctgtgaatccttccgattctttgttcaagccgcatcgggttccacgggaggtcataattgataatatggttgcagaattgcaggttgatcccttcgcctccggcttctgtagcgatcagcacctgcactttgccgcggaaaagatccttcatccagtctttttttccgcgtttaaatccgcctctgaacggaacggagcttatgccgttctgctgaaggaaccattgcaggtaaatctgtgtcgccctgtattcagtaaaaataatgactttatcattaatcttttggatcaagtcaacaacttgaatcgcttttgagttttgcgtgacttgattgatgcggtccattaaattagcgatcgtctgttcatcgaatgcgggcgcttgtttgtctttttggtcaagcatttttttgagcgtcatatacacggcttccctgcttgaacagcactctctttgcagcgtcataatggaaaatgcgcttgcgggcttttccgtgccgtttttcagtgcggcaatgtcatcgtaaagcgcctgttccgtcggtgaaaaggtgatcggcactgtttccacgtggcgcttcgtccatgtaaggccggtgtcgctccgcgtgttgcggatcatcaccttattgacgagttctttcaaatgctcatgagcgtcaatcccgtccttctgattgaaggtttcttgaaatccgctttcatttcctaaatggccgggctttaacagtgacactaaattgaagatttcttcgatccggttttgaatcggcgtcgccgtcagaagcaggcagtatttcttcacaagacttctcgcaaattcataatttttcgttttgctgtttttgagcttgtgcgcctcgtcaataatgacgagatcatacggaatagaaaggacaatgtctttgtgaggggagcgtttggccgtatcaatagaagaaacgacgatatcgcactgttcccacacatagcttttcttctgttcaacagcgggtattaaaaacttctcctgaagctctttcacccactgggaaacgagtgatgccggcacaagaatcaggatttttttggccagcccgcgaatcatatattcttttaaaatcaggcccgcttccaccgtttttccgagccccacttcatcagccaaaatcgccttgccgttcattttttcaacgactttctgcgcgacctcaagctgatggggaagcggagtgaaatcgggcaggtataaaggagctctcaacccttcaaattcaggaatggcaagggtctgctggacttcagccgacagtttgtacagctcccaatttgaccagggaccgtccgttttcagccgctcagaaaactctcccggccagtttgcatcaaatatgatctctgctgtcatatgtaacaaaaccgcctttcttttaaaaaactgatttatcataatttttgttgccggacgtaaatgagggtggtaggatataagtaatgatttcactaaaagatattgctttagtatgtccataaaattggtaaatatgagcgaatgacagcaaggggagagactcggacgaaagatgggcgtccgggcgccgaaggagcaaactgcggagtgaatctctcaggcaaaagaactcttgctcgacgcaactctggagagtgtctgcacttagaagaagcaggccaccaaaggggacgtctttatgatatgttcataaagtaaactttcaggtgccgggacagagaaaccttcattttcatgaggtgtttctctgtccttttttatatgtttttacaagcgccaatgactgaagggggaagatgatgctgaaacgaacaccgctttatgatgtgtataaagaatacggcggaaaaacgattgattttggaggatgggagctgccggttcaattttcttctattaaagaggagcatgaagccgtccgcacaaaagcgggcctgtttgatgtgtctcatatgggggaagttgaagtatccggtaaagacgccctgtcttttctgcaaaaaatgatgacaaatgacgttgccgatttaaagccgggaaacgcgctttataccgccatgtgctatcctgacggcggtacggtcgatgatttgctgatctatcagaaaagcgagagctgctatctgctcgtgataaacgcgtctaatattgaaaaagacatcgcctggctgacagaacatgcggaaggagatgtcacgctgacgaatcagtctgacgggatttcactgcttgccgttcaggggccgaatgctcagtcggttcttgcgaagctgactgaatgtgatctgtcctccttaaagccgtttgcatttattgacgaggcggacgttgccggacgccaagtcctgctttcaagaacaggctataccggtgaagacgggtttgagttatattgccgcaatgaagatgcggttcatctatttaaggagatacttgcagcgggagagcatgaaggcctcgttccgtgcggcctcggcgcccgtgatacgctgagatttgaagcgaagcttgctttatacggtcaggaattgacgaaagatattacaccgattgaagccggaatcggatttgccgtgaaacacaagaaagattccgattttttcgggaaatctgtattgcgtgaacagaaagaaaaaggagccccgcgaaagctggtcggacttgagatgattgaaaaagggattccgagacacgggtacgccgtgaaaaaagacggtgttccgatcggggaagtcacgacaggcacgcaatctccgactttaaagaaaaatatcggccttgccttaatcaaaacggaattcagtgaagtcggaacggaagtagaagtggaaatccgtaaaaaaacggtaaaagcgaagatagtccgcacaccgttttataaacgtccaaaacagagctgaaaaaggagagtcatatgaagcatcgatatttgcccgcgacagaacaggataaaaaagaaatgctgaaagccatcggcgcagaaacaattgatgaactgtttgccgatattccggaagatgtgaggtttcaaaaagactaccaaattaaaaaagcaaaatctgaaacggagctgacgagagagctgacaaagcttgcggcgaaaaataaggacgctgttacatatgcgtcttttctgggcgcaggagtgtacgatcactaccagccggtcatcgtcgatcatgtgatatcccgatcagagttttacacggcatatacgccttatcagcctgaaatttcacaaggggagctgcaggcgatttttgaatttcaaacgatgatctgtgaattaacgggaatggatatcgcaaactcctctatgtacgacgggggaacggcgcttgcggaagcggcgatgcttgcgtcgggacatacgaaaaagaaaaaaatcattatttccgcagccgttcatccggaatcacgggatgttttgaaaacatacgcaaagggccaatatattgaggttgtagaggtgcccgcgaaaaacggcgtcacagatcttgaagcattggaacatgccgtttgtgatgagacggccgccgtgatcgttcagtatccgaacttcttcggacaaatcgagccgttaaaggacattgagccgctcgcacataaaggaaacagccagctgattgtttcttcaaacccgctcgcgctcggtattttgacaccgcccggggcatacggagctgatattgtcgtcggagacgcgcagcctttcggcatacctgcggcgttcggcggcccgcactgcggctattttgcagtaacgaaaaaactgatgagaaaggtgccgggccggcttgtcggccaaacagaggatgaaaacgggcgaagaggttttgttctcacccttcaggcgcgcgagcagcatatcagaagagacaaagccacgtctaacatttgttcaaatcaggcgctgaatgctttagcggcttcagtcgcgatgacggcgctcggaaaaaacggcgtcaaagacatggcccgccaaaatatattgaaagctgattacgcgagacgccaagcggaaaaagccggcttgcacgtagcatttgacggcccgatatttaatgaatttgccgtcaggctgaatcttcccgtcaaggaagcaaaccggcggctcctgcaagacggcatcatcggcggatatgacttaggtcttgcgtatccggaactggatcagcatatgctgattgccgtcacagagctgagaacgaaagaagagatcgattcgcttattgcgggattgggggatcaacatgaataatcaagatcaggcgcttatttttgaaatgtcccgcgaagggcgtgtcggttacagccttccggagcttgatgtgccggaaacagagcttgaaagccttcttcccggtgactatatccgcgatgaagacgcaaagctgccggaagtatcagagcttgatattatgcggcattataccgctctttctaagagaaaccacggagttgattcaggcttttatccgctcggctcctgtacgatgaaatacaatccgaaattaaatgaaaaaattgcccggttcgcaggtttctccgctattcatccgcttcaggacgaggacacggttcagggggcgcttgagcttttatacgatttaagcggacacttggaggagattacgggcatggacgaggtgacgctacagcctgcggcgggcgctcacggcgaatggaccggcctgatgatgatccgcgcctaccacgaagcgcggggagacttcggacggacgaaggtgattgtccctgattcagcccacggtacgaatccggcatccgccacggtcgccggttttgaaacgattaccgttaagtcaaatgagcacgggctggttgacattgaagatttgaaaagagcggtaaacgaagaaacagcggcgctgatgctgacgaatccgaacaccctcgggttatttgaagaaaacattacggaaatggctgaaatcgtccatcaggccggcggaaagctttattatgacggagcgaatttaaatgccgttttaagtaaagcaagaccgggagatatgggatttgacgtcgttcaccttaatctgcataaaacatttaccgggccgcacggcgggggaggaccgggctcagggccagtcggagtgaaaaaagaattcattccgtatctgccgaaacccgttctcacgaaaaaagagggccgtttgacttttgactatgaccggccgcagtcgatcgggcgcgtaaaaccttattacggcaacttcggcattaatgtcagagcctacacgtatatccgttccatggggcctgacggcttaaaagctgtgaccgaaaacgcggttttaaatgcaaattatatgatgagaagactcgcgccttattatgatctcccgtttgaccgtcattgcaagcatgaatttgtgttatcgggaagaaggcagaaaaagctcggcgtaagaacgcttgatattgccaaacggcttttggatttcggctatcatccgccgactgtgtattttcctctcaatgttgaagaaagcatcatgatcgaaccgacggaaacggaatcgaaggaaacgcttgatgcgtttatagatgccatgattcaaattgcgcgggaagcggaggaatcgcctgaaatcgttcaggaggcgccgcatacaacagttgtcaaaagaatggatgaaaccaaggcggctagaaagccggttttaaaatacgaacgtacacctgacgtcagccgctgacacggtataaaaaaagagcttccgtataaaacggacagctcttttttcatgattagttttttgctttaatttttccgccccattttttaaatccgcctttcaggttgtaaatatctttgcagccgtgtttgcggagcgtctgtgccgcgcgtccgctgcggacattgttttggcagtacagataaacgggtttatcaggacggatttcacttttgcgctgtttcagctgtgacagcggaatgttgcgcgcgccgagaatatgaccgccttcaaattcattcggttcacggacgtcaatcagctgcgcttttctgtagcccgcgcggaattcctcttccgtaagtgttttcattaaacgctgctggtaaaagtacgaaacgatcatataaacgataaacgccgcaacaataattaaagcaatcatattagacaatgcaattctactcctttagcttataaaatcaaaaccctgcttcctgaaaacaaggcttaccggacgttttgggacaaatactattatagtaaagcatgaagcgattgtcatccttaatgaaacgaaatatttttcattttcaaggcagtttgttaaactggttttattaaaacgataaagaagggttcagtgtatggaaaaagaaacatggcggtttattgactcagggaatgaaagcccggcatttaacatggcgctggatgaagcgcttttatattggcacagccaaaaaaaaattcctccggtgatccgtttttacggctggaatccggcaactttgtctgtcgggtattttcaaaatattaagaaggaaattaactttgacgcagtacataaacacggcctcgggtttgtcagaagaccgacaggcggacggggtgttctgcatgataaagaattgacatacagcgtaatcgtttcagaggatcacccggaaatgccggccacggtgacagaggcgtaccgggtgatttcagaaggtattctgcagggattcagaaaccttggacttgatgcctgctttgcgattccgcgaacggagaaagaaaaagaaagcttgaaaaatccgcgctcgtccgtctgctttgatgccccttcgtggtatgagctggtcgtcgaaggacggaaagttgccggaagcgcacagacacgccaaaaaggcgtcattcttcagcacggttccatcctgcttgacattgatgaggataagctgtttgatctgtttttatatccgagcgacagagtccgtgagcgcatgcagcggaatttcaaaaacaaagcggtagccatcaacgccttaacgccgaaacgggtaacgatggatgaggccagaatcgcttttaaagccggttttgaggaagggctgaacattcatcttgagccttacacactcacgtctgaagagcttgcatttgtcaatgagctggctgagacgaaatacgcgtctgatgaatggaattataagcgctgataaggcttgacagaccggaagcatccttgttttttcatgaccgttagtgtaaacttgtaatggtttataaagttaaggtgctttttgggagggttacttatgacaacaccaagtatggaagattatattgaacagatttatatgctgatagaagaaaaaggatatgcacgggtttctgatatcgcggaagctttggcagtccacccctcctctgtaacgaaaatggttcaaaaactagataaagacgagtatttgatttatgaaaaatatcgcgggctcgtattgacgtcaaaaggcaaaaagatcggcaaacggctcgtatacagacacgaattgcttgagcagtttttaagaatcattggtgttgatgaagagaagatttacaatgatgttgaaggaatcgaacatcatctgagctggaacagcattgaccgcatcggcgacctcgttcagtattttgaagatgacgaaagccggaaaaaagaattgaaatccgtacagaaaaaaaccgaaaatcccggtgaataaagggcagcccgaaatggggcgccctttttttaatgtcttcattctttggtctatttcgcccagccgtttcttaaaataataatacaccttgagatggaagggagagggcgcgctatgcagattgacggcgtattttcgggcggggggataaaaggggtggcgcttgccggcgcttatgaagcgctggaagaaaagggctttcgctttgaaaggctcgccggaacaagcgccggcgcgattattgccgcatttatcgctgcgggctatacgagcagagaggttcattccatcatagatgaggtggacggaaggcaattgcttgatcagagatactcattcctcccgctgaaaatcctgcagtgggtgtcgatatattggcgcctcggactatacagaggcgatatgctggaaaagtggattgcggataaattaaaagcgaagggcatcatcgcgttcggcgatttgaaaaaaggctcgctccgtctcatcgcttcagatctgacgaacggaacgatgatcgtgcttcctgacgatcttccccgctacggattaaatccggagatgttcccggttgccagagccgtcagaatgagctgcagcattccttatttttttgaaccgataaaactgaagaccgaaaaaggcacctcaacggtcgttgacggcggcgtgttaagcaatttcccgatttggctgtattcaaaagaacgcaaacggccggtcatcggaatttcgctttcgcccaacgaaaaagagcgcccgaaaaaatcaatccgcaacgcttttgagctgttcggggctttgtttgaaacgatgaaagacgctcatgatgccaggcatatcgcgacaaagtacgaacagaatattatttttattccggtggaacatgtgatggcgacggagtttcatctcacaccgcaaaaaaaactagctctcattgagctaggaaaaagcagaacagagcaatttttgaagcaatggagctattaaaaaagcgctctgtttttctttttattctttttgccttctatgacggtaagctgggtctggctttttttcttaagaatcatcggcttcggtctgctgctgctcggcacgctccgcaaatggctgacccggcctctgtgtccggcgcggtgcttcgctttttgctccttcattcggagccgcgattgtctggccgcttttttgaaagcggttccgtcacggccggtgcgtcggttcaggaccgtcctcacgataaaataaataataatgcctgcgataataacggtgattgctcttgaaatcatctgcccggggttggttaccgccgcataaatgaaaccgaatgcgccaagcgctatcaatacagcaaaaaaaggttgtacacgatgattcataactgcccacctccaaaataataacggtaacggttcagattacgttgtgagacggattttcgctctgttctgaaatgtcttccagtctgagaagctcgttaaagctttctatggcaacctcgacctggtcatccgccggttcctttgtcgttaaaagctgcagccacaggccgggataaccgagcactttcaaaacggggatattccgtactctgttcgtcagctggagcacttcaaaggagatgccgagaacgaccggtataagcgcaatcctgtctaaaatccgcacccaaagcggatctgtcggaacgagtaaatagacgaacatgccgacaatgatcgtaaataaaataaagcttgaaccgcaacggtaatgaagccgtgactgtttctgaacattttctattgtaattggcaaattctgttcataacagtttatgaccttatgttcggctccatgatattgaaacactcttttaattaacggcgtcattgataaaaaataaatgtagccgagaagcagaatcagcttaaacagactttcgattccgatctgcgcggcgtctgaggaaaatacgggccttacaagctccgctaagaagaccgggacgagcgtaaaaacgaatttgctgaacaaaaacgacagaacgccgatcaccgccaggctgaaaaacatcgataagccggaacccttcttctcttcctgctccagcttggcgtcatcctgaggatcaagcccgtaacgttcgctggaaaagtttaaatgctttgtgccgttggcgctcgcctcaatgatggcgacaattccccgcaaaaaaggaatcttttttaaagccgaaagcttggcgttcggcactctcggaagcttgaaaaaatcaatgcttccgtcattcctgcggatggcggtaacataattttttctgccgccgaacattaccccttcaacgacagcctgcccgccgtatgcagggggcgttttttgtttggacattgtttatcaacctgcctgttttcttaggatttactaaccatttcctttcactctattgtacaggaaaccgcggtaaacctctagttagacagccggaaaatcaatgctttttctacatgcagtataccccgtttctttagattttactcattgaatgaaaatatggcgcagctttttatgacttttcaatttttgggcagtctatgactggaggtgccatgatgacaagcgaaaaacattcagaacaggaagaaaaaaagaagcaggatgatgatcagcagcctgtttcatttaccggcagaatttgcggtatcggatttgccggcggtgtattttggagtttgatcggctatctcgggtatgtctttcatttttcagagatcagccccaacatgattcttcagccgtttatgatcggagaatggaaaaaacaatggctgggcacgatggtcagcatcgttgtcatcggattcatttcaattgccggggcgtttatttatttcgtctgcctgaagcgttttaaaaccatgtggccggggatggtgtacggcgtcattttatggtgtgcggtttttttcttattcaatccgattttcgaagatgtgaaatccgtcactgaattgaaatcagatacaatcgtgacgacgctttgcctttacattctgtacggtttgtttgtcggctactcaatttccttcaactacaatgaacttacgtcagacaagcttgcaagggcgctcggcaacaagtgaataagtgtataatccctgtccggtatggtaaaatgttcacgagaagtgaacattttttatgctgaaaaccgggcagggatgctcccgcgttgtcaggcggcagtcaagaatcggcgaggaggagaaagggaatgaaacttgagaaattgcgaaatcttttcggtcagctggatatagacggaatgttggtgacaagctccgccaatctgcagtacatgacgggatttacgggttcgtcaggccttgcggtcatatcgaaagaacgtgcggcatttatcacggatttccgttacaccgagcaggcgaagacgcaagtgaagggttttgacattatcgagcacggcggaagcttaatccaaacggctgcggatacgattcttgagtacggcattaaaaaactcggcttcgagcaaaacagcatgacgtacggaacatatgcatcctaccaagcggtgctgcaggaagcggagatggttcccgtcgcggattccgttgaaaagttgcgcttgattaagtcaagtgaagagattaagatattagaggaagctgcgaagattgcggatgatgcgtttgaacatattctgacgtttatcaaaccgggcatctcagagatttcagttgcaaacgagcttgaattttatatgagacgtcaaggagcagacggctcttcctttgatatgatcgtcgcctcgggagtcagatccagccttccccacggagtggcaagcggcaaattgattgaaaagggagacttggtcacgctcgatttcggcgcttattataaaggctattgttctgatatcacacgcaccgtcgcggtcggagagccaagtgataaactgaaagagatttatcaggtcgtatacgatgcccaagcgcttggtgtcctgcatattaaacccggcatgacgggaaaagaagcggatgccctgacgagggatcatatcaccgcaaaaggctacggacagtatttcggccattcgacaggacacgggttcggaatggaagtccatgaatcaccggggctgtctttcaggtcatcggccgttcttgagccgggcatggcggtaacggttgagccgggcatatacataccggaagtcgggggcgcaagaatcgaagatgatatcatcatcactgaggacggcaaccggacaattacgcattcccctaaagaattaattattttgtgatcggagtataggaggacatcaaacatgatttcagttaacgattttcgtacaggactaacgattgaagtagacggcggcatttggcgcgtcgttgactttcagcacgtaaaaccgggaaaaggagcggcatttgtccgttctaaattgcgtaacctgcgcacgggcgctattcaggagaaaacattccgtgcaggtgaaaaagtcgcgaaagctcaaatcgaaacaaaaacgatgcagtatctttatgccaacggcgatcagcacgtgttcatggatacaagctcatatgaacagcttgaattgaacgaaaaccaaatcgaagaagaattgaaataccttctggaaaatatgtctgtgcatatcatgatgtatcagtctgaaacgctcggtattgaactgccgaacacagttgaactgaaagttgttgaaacagagccgggaattaaaggcgacacggcgtcaggcggcacgaaacctgccaaaacggaaacaggccttgtcgtaaacgtaccgttcttcgtgaacgaaggcgatacgctggttgtaaatacatcagacggttcttacgtgtcaagagcgtagttaaagaaattcggagtctgctccttttacggggcaggcttttttttgcgttctgcctcagaatctttcttctatatgaaaatagtgagactacttccgtgagctagagcatatagtgtaacaaaatgcttgaagttgggggattgcaatgaaatttttgttcggttcaatcaattctactgttttaacgatggccggtttacgagttttgtcctcgctcattgaattatctgccgctattatcatgcttttgacaaacgacatcagaaaagcggttgtggtgaatagtattttggcaatcgtcggccctctgatctttatcatcacaatgacgatcggcatttatcagattgccggacagctctcatatgcaaaattaatattgatttttgcgggtgtggtgctgattttggccggtgtgcataaatagagggccggggtgtcataaagtctgtcccggatcatacattttaaagaagccaatcggtaaaaaggaggggactctattgaatgaaattacagaggttctccctgaattattgagagatgccatctccgccgtgcccgaagaagcgaggcgggatacagaagaaatcagaatccgggtcgacaggccggttgaactgatccaaaaaggacaacctttgtatttgtcatatgtgtgtacggccggcgacgcacagctgatcctcagccggctcagcaactatagtatgtacacgctggaagaagagctgaaaaaaggatacatcacaatcagaggaggccaccgtgtggggctggccggaagagtcatcgtcgaaaacggagccgtcaaaggactccgggatattacttcttttaatatccgaatcgcccgggagaagctggggatcgcagaaccgctcattcctttcttatggaaagaaaactggctgaacacgctgatcatcggtcctccgcaaacggggaaaacgaccttgcttcgtgatttggcccggctttccagcaccggatcaaaacgcattccggcaaaaaagacaggtatcgtagatgaacggtcggaaattgccggctgcctgcggggcattccccagcacagtttcggccgcagagtcgatgtccttgatgcctgtccgaaggcggaagggctgatgatgatgatccgttctatgagtcctgatgtcataattgtggatgaaatcgggagaatggaagactcacaagcgctgctggaggcgctccatgcgggcgtatccgttatcgtctctgcgcacggatggaatatgaaagacttggtcaagaggccgtcgctgaaaatgctttgggaggaaaacgtgtttgaccggtatgttgaactgtcaagacgccgcggtccgggaacgatcagcaggatgtacggaaaggacgggaaacctgttccgcatgctgaaagcgtgatgacatgctgaagcttttgggtgccgtgttcattctgacagcgacgacatggacgggatttgagatcgccaaaatgtatattgaaaggccgagacagatccgtcagctgcgcgcggcgctgcaatcgcttgaagcggaaatcatgttcgggcatacgccgctgcacatagcttcgggacaaatcgccgcacagctttccaagcctgtatcgtcattgtttcaagctttcagcaggaggcttgagcagggaagcgattccgccaaaacggcctgggaacagagcttgaaacataactggccctccatggcgatgaaaaaaagcgaatacgatgtgctgaagcaattcggagagacgctcgggctccatgaccgtgtttctcagcagaaacatatcaagcttgcgcttacacatttggaagcggcggaagcggatgccggacgggcgcaggcgaaaaatgaaaaaatggtgaaaagcttaggatttttagccggactgttactcattcttctattgatgtaaacatgaggggagcaaacataaaatgggagtcgacgtaaatgtcatttttcaaatcgccggagtcggtatcgtggttgcgtttctgcacaccatacttgaccaaatgggaaaaaaagaatacgcccaatgggtgacgctgcttggctttatctatattttatttatggtggcgacgattgtcgatgacctgttcaaaaagatcaaagctgtgtttctattccaaggataggggggcttacagattgagattgttcaaattgtaggtttaggcctgatcgccacatttctctccctgatcgtaaaagaacagaaaccgactttcgcgtttatgattgtcgtcttcagcggctgcgtgatctttctctatctcatcgatcagatttacgacattatcagaatgatagaaaaaatagccgtcaatgcaaatgtcaatatggtctatgtggaaaccattttaaaaattatcggcatcgcctacatcgctgaattcggtgcgcagctgacaaaggatgcgggccagggagcgattgcttcgaaaatagagctggccggaaaaattttgatactggtaatggccgtgccgatactcaccgtcattattgaaacgattctcggacttattccttcttgatcatcaataaaatggaaaggggggcacaaaaaatgaagcgctttcggtgggcgggggcttttttgttcatcctcttattttttcagactgaatgtgtacaagctgccggaacagacggtgcgtcgcaggaaaccgcagttcaccaagaatccgctgatgaagtggcgaaaaagcaggccgaagcgctgaaaacagaaggcatcggaaagttttgggacgacatcatgacagaatacggcggtcttctgcctgaaagccaaaagggaagcatcatcgactttattaacggtgaaaaaacgttctcgccggaggcatggctgaaggctttattttcatacttgtttcatgaagtgctcgcaaacggaaagcttctgggaactttgattcttctcaccattttttgtgtcattctgcagcttttgcaaaatgcgtttcagcagagcactgtcagcaaagtggcttatgcaatcgtctacatggtgctgattattctcgctttaaacagctttcatgttgccgtcaattatgccagtgaagcgatccagacgatgacaagtttcattctcgcgctcatcccgcttttactcgcgcttttggcgtcttccgggggagccgtctccgcagctttttttcaccccgttattttatttctgatgaatacgagcggccttctcattcaaaacattgtcatgccgcttattttcctgtcagcgattttaagcatcgtcagcacgatgacggatcaatataaagtcacgcagcttgccaatctgctcagaaatatcgcgatcggcgcgcttgccgtatttctcaccgtgtttctcggcgtcatctccgtacagggggcttcggctgccgtgacggacgggattacgctcaggactgcaaaatttatcacaggcaattttattcccgtgctcggccggatgtttacggatgcgacggatacggtcatcagcgcatcgctcctattaaaaaacaccgtgggaatcctaggagtcggaattttgatctgcatctccgcgtttccggcgatcaaagtgctctcgctcgcttttatttataagctcgcggccgctattctgcagccgctcggaggcgggcccgtcattacgtgcctcggcgtcatcagccgaagcgtgctgtatattttcgcggcgctcgccatcgtctctctcatgtttttcctcagtattacagtcattattacagcaggcaacctcaccatgatgatgaaataaaggaggcccattggatatgagctttttaacagaatggctgacaagcattattttgtttatcttattcgccatcgtcatcgacatgctgctgcccagctccagtatgcaaaaatacgccaagatggttgtcagcctgctgttaatcattgtcatgctcaacccgatcttcaaacttttcaaaacagacccggaaatcatcttcgattatttgacaaaacaagagcaatctcaatccgctgatataaaaaatcaaatcaaatcagaaaaaaaagaaatacaagcatcaaaccgcgcatatgttttagaagaaatggctgtccaactaaaaaagaaagcggaggagatgttcagtcatgacgaatacaaaatagacgacatccgccttacagcggaagaacaggttcgttcagaagaagatgtaaaaacgatcagcgtgtatatggccccatcttctgaaaaaaccgtgcaaaccgtcgcaccgatcgacatccgcacagaccgcaaatacgaaccggaaggcgcagccgaaaaaaaagaggccgcagacatcaaagaaaaacttgcggatatatgggaaatcggcagtgagaaaattacggtttatatggaaggcggggagaaaaacggccatgaataaaaacggactatggaccatactcaaaaaacagctgatgatcggacaggcgaaagacggagaaaaaccaaaactgacaaaatatcattactttctgttcgtgtttgtgctcggagtatcttttatgctggtgagccagctgttctcttcaccggagaaaaccgggaaggaccaagcggcgcagaccgtcatgtccggccgaacggaagacaaaagcgggcaaaaaagcgcacccgtttttaaggcatcgaaagacagcagcgccaaaaacacgatcgatgattatgaaagagactatgaaaaccagctgaaagaaatccttgaaacgattatcggcgtggaggatgtatcaattgtcgtgaacgtagacgcaacatctttgaaagtgtttgagaaaaataaaacgaaaaaagacaccaccaccgaagaaaccgataaagaaggcggcaaaagaagcgtaaccgatcaaacctctgaagaacaaattgtcatgattcgaaacggggatcaggaaaccccggtcgtcgtccagacgaaaaagcccgatatccgcggtgtactcgttgtcgctcagggagtggacaacgttcaaataaaaaaaaccatcattgatgccgtcacaagggtgcttgatgttccgagctaccgtgtagcggttgcccctaaaaaaatcaaggaggattcataaatcatgctgaaaaaacaaacggtttggcttttaacaatgctcagtctcgtcgtggtattaagtgtttattatattatgtcgccggaaagcaaaaatgccgtgcagatgaaaagcgaaaaaagcagcggagaagtggcaactgaaaaaacgccggctcctgaaacgaaagataagaacggaagcggcacggataaagaagacggaacaaaaggaacgaaagattctaaaggcgcaaaagaggataaagaaacatcagccgaagcatcggacaaagacggatcggtcgctacagaaacagctgatgaaaacttatttaccgcataccgcatggaacttgaagacgcaagaagcaaagaaagggaacagttaaacagcattgtttcaagcgatgatgcgaccgcaaaggaaaaaagcgaagcctacgataaaatgacggcgctgagcaatgctgaagggacggaaaaacagctggaaacgctgattaaaacacaaggctacaaagatgcgctcgtggatgctgaaggagacaaaatcaacattacggtcatgtctgacaaacattcaaacgcaaaagcttccgctatcattgacctggtggaaaaagaaatcaagacgatgaaagacgtcgccgtcacgtttgaaccgacaaaataagagatctccaccgcccgcacccgctgcgggcttttctgatgtcattttagatcagtgttgaatttacacaagcgctcctgtaagataaacatagtatgtacttttagtagcaacccataaatttctattttttatacataggagtggaaactgatgttaaaaatcaacgaaattcatgaactgataaaaagaatcgatgaatcttccatcgacgaattcgtttacgaaatcgaaggcgtaagcctcaaactgaaaaaaaatgaagcgccggcagtgaatgtaacgggacaagctcaagccgttcccgccgcttacgcacctgctccgcaggctgcaaaaccggaagcgcatgaagccgctcctgttcaggaagcgccgaaacaagacgaaaacctgcacaaaattacgtctccgatggtcggaacgttttatgcttcttcatcgccggaagccggcccttacgtaaaccaaggttcaaaagtgagcgaaaatacagttgtttgtatcgtagaagcaatgaaactctttaacgagattgaagccgaagtaaaaggagaaatcgttgaagtgttagttgaaaacggccagctggtcgaatacggacaacctctatttcttgtaaaagctgagtaaggagacctgctattatgattaaaaagctattgatcgccaaccgaggagaaatcgccgtcagaatcatccgggcctgcaaagagctgggcattgaaactgtagccgtttattctgaggcagataaagacgccctgcatgtccaaatggccgatgaggctttttgtatcgggccgaaaacatcaaaagaaagctatttaaatgtaacgaacatcgtcagcgtcgcaaagctgaccggcacggatgcgattcatccgggatacgggtttttagctgaaaacgccgactttgccgagctgtgcgaggaattgaacgtaacgtttgtcggccctacggctgacgccatttcaaaaatgggaacaaaagatatcgcgcgcgacacgatgcagctggctggtgtgccgattgtgcccggttcaaaaggaatcataaaaaataccgaagaagcggtttcgcttgcaggtgaaattgggtatcctgtgattataaaagccactgcgggcggaggcggaaaaggcatccgggtcgcacgcacagaagaagaactgatcaaaggcattgagattacccagcaggaagccgctacggcattcggaaatccgggtgtgtacatcgagaagtacatagaagatttccgccatgttgaaattcaggtgcttgcggataattacggaaacacgatccatctcggagagcgtgactgttctatccaaagacgtctgcaaaaacttcttgaagagtcaccgtcacctgcgcttgattctgaaatcagggagcagatgggcgaagctgcggtaaaagcagcgaaggccgtcggttacacgggagccggcacagtagaattcatttatgactacagagaacagcgctactacttcatggaaatgaacacgcgtattcaagtagagcaccctgtcacagaaatggtgacgggaacggatctgatcaaagaacagatcaaagtggcatccggacaggagctttcgctcagacaggaagacgttgaatttaacggctgggcgattgaatgccgcatcaatgctgaaaatcctgcgaaaaacttcatgccttcacccggtaaaattaacatgtacctgccgccgggcggactcggcgtacgcgtggattcagccgcatatcccggctattcgatcccgccgtactatgacagtatgattgctaaagtcatcacatacggaacaacgcgtgatgaggcagtcgcacggatgaaacgcgcgctgagcgaattcgtgattgaaggtattgaaacgacgattccgttccatctgaaactgcttgaacacgaaacatttgtcagcggagagtttaatacaaagtttttagaaacatatgatgtaatgggctcataatttttgcgggaggtgaattgaatggaagacaacagtgtgcttaaaatggatcatgacgaggctcatttaggcaaggttgaaattgctcctgaggtcattgaagtcattgccggcatcgccgcttccgaagttgaaggagttgctgaaatgcgcggcaatttcgccaccggcgtcgtagaacgcttcggcaaaatcaatcacggtaaaggcgtaaaggtcgatttagccgatgacgggattaccatcgacgtctattgcgtcgttcaattcgggatctcgatcccgaaagtggcggcaagcgttcaggagaatatccgccaaaccttattaaacatgacgtctctgaccattaatgaaatcaatattcatatcgtcggcattcaatttgacacgaaagcccaagaagtcgaaatcgacgaagaaatgtaatgagcgtataaaaaccaaggggatgggcagccctttggttttttatacgtttcccgtcatttcaggcatgaagaaagccggcttacaaacggcagccgagtttcttcatgctgtgaaatccgaatgaaattaatacggtttgtgaaaatattcggcattagggtgaaaaaacctaaatttcgacatgcgattgagaaaaaaatatgttatgatctctttaagcttaacgacaagcggataaagcggatctgaaggagaaagaaaatgaaaagaagaacagctagagaaaaagctttgcaggcactttttcagattgatgtcagcgatattgcaccgaacgaggccattgagcacgcgcttgatggtgaaaaaacagatgccttctttgaacagctggtgtacggagtgatcgaacatcaggttcagcttgatgaaatgatttccggccatctcgtcaattggaagcttgaccggattgcaaacgtagaccgcgcgatcctgcgtctggcggtgtatgaaatggtttatactgacgacattcctgctaacgtgtcattaaacgaagcaatcgagctggcaaaacggttcggcgacgataaagctgcaaaattcgtaaacggggttctttctaacattaaaactgatatcgaatcataggaggaaagaaaatgactgcaacaatcatcgacggaaaagaaacggctaaagaaaaacgcgaacaattggcaaaagaagtagaagagctgaaagcacaaggcgtagtgcccggtttggcggtcattttaatcggagacgatcccgcttctgtttcatatgtgacaggcaagaaaaaagccgctgaaacaatgggaatgaaatttaaacttgaccgctttgactcaagcttaaccgaggcggagcttttaacagtgattgatcagtataatcaaaatccggaattccacggcattctcgtccagctgccgcttccggatcatatttctgaaaaagccgtaatcgagcggatctctcccgataaggatgttgacggtttccaccctctcaacgtcgggaaaatgctgcttggcgaagatacatttctaccatgcacgccgcacggaattgtcgagttattgaaaaagacgaacgtagatctttccggcaaagaagttgttgtagtcggacgaagcaatattgtcggtaaaccggtcggccagctgctgctgaacgaaaacgcgaccgtcacatattgccattcccgtacgaaaaatatgtctgagcatacgaaaaaagcagatattcttgtggtagcggtcggtaaagcgaatttcatcaaagccgatcaaatcaaagagggcgccattgtcattgatgtcggcgtcaaccgtctcgaaagcggaaaactctgcggagacgttcagtttgatgaagcgaaagaaaaagcatctttcattacgccggtgccgggcggagtaggtccgatgaccatcacaatgcttgcgcataatactgttaaatctgccagacgtacgttatcatagataaccggagacagtcacaaaaagtgtgacaatgagcacgatacccgcttcttaaggctcctttcagccagagcgggttttcttagtttagggcaaaaagcctttatgaaaggagtgcaggatgtgagtgaagcggcatatgtcacggtttccgcgctgaccaaatacattaaacgaaaattcgatgtggaccctcatcttgaagacatttggattaagggtgagctctccaatgttaaaattcatacgagaggccacatctattttacattaaaagatgagcatgcccgcatgcaggccgtcatgtttcaaagacaaagttcgaggcttgcgtttaagcccgaggacggaatgaaggtcatcgtaagaggcggcatttccgtctatgaaccgagcggaagctatcagctgtacgcgaaagaaatgcagccggacggtgtgggggcgctctacttagcatatgaagaattaaagaaaaaacttgccggcgaagggttgtttgatgaccggcataagcaggccatccccgcttttccggctacgatcggggtcgtcacgtcaccgacgggagcagccgtcagagacgtcattaccacactcaaaagaagatacccccttgtgaaagtcattgtgcttcccgcgctggttcaaggtgaaaatgccagcagatcgattgtgaagcgcattgaagaagccaatgcacaaaaaatgtgtgacgtcctgatcgtcggaaggggagggggctcgatcgaagaattgtgggcatttaacgaagaaagcgtagcccgggcgatttttgcttccgccattccgattatatcagccgtcggacatgaaacggattttacaatcagtgatttcgtcgcggatatccgggcggcaacgccgacaggagcggcagaaattgccgtcccccatacgacggacttaatggaacggacaaaaacggcggaagtccggctgacaagagcgatgcagcagcatatcagcaagaaaaaagaacgggttctatcgctccagtcatcctacgcgttccgttttccgaaacgattgtatacccaaaaggaacagcagtttgatcttttgtatcagcagttccaatcacagctcacagggcttacggacaggaaacaaaggcagctggagcggaatacgtacagattaacggcgctccaccctgaaacccagctgaaacaggcgaaaaaacggtacgaggagcgctcaaatcagctcgcccgaagcatgaatgtccagctgaagcagcttcattcgcagtttcagacggttcttggtaaactgaatgcattaagtccccttcaggtgatggagagaggatacagtctggcctataaagataaagagctgatcaaaagcgttgatcaagtggaacaaaatgatacgcttgaagtaaagatgacagacggcgttctgacgtgtgaagtattgcaaaagagaggcgaacgaaaatgacagaaaccaaaaaaagtgaagagctgacatttgaagaggcgatgaaaggccttgaaggcattgtggcaaagcttgaagaaggagacgtgccgcttgagcaggcgattaattattttcaggaagggatggccctttcaaaaatgtgccatgaaaagcttcagcatgtcgaaaagcaaatggactttattttaaaagataacggcgaacttgcacctttcagcgttcaggaggaagacgaaggtgacaaataaactggacgcatttttagcatcgcgcaaaaaactgattgaacagcagctttctttgtatacggaacggcttgcgatgcctgaaatcctcaaaaaatctatgctgtattctttggaagcgggcggaaagaggctgcgccccctcgtcgtcttagccgttctgaatgcttacggaaaagatgaaaaagacgggattccggtcggatgcgctgtcgaaatgattcatacgtattccttaatccatgatgatcttccttgcatggacgatgatgatctgcgccggggaaagcccacaaaccataaagtcttcggagaagcggcagccgtattggccggagacgggcttctgacagaaagctttaaattgatcacatcccacgtgtctgaggcggtttcagcagaaaaacggctccgtctcgtcgatgagctgatcagcgcggcaggaacggaaggaatggtcggcgggcaggctgccgacatggaagcggaacaaaagcggataacgcttgaggagctggaatccatccacgagcggaaaacggccaagctcctcggtttttctgtgacggcgggcgccattttggcagatgcgccggaggatgaagtcgaaaagctgcgtctgttcagcagccatatcggcatcggatttcaaatcagagatgacatccttgatattgaagggcatgaggagaagatcggcaaaccggtcggctcagacacgtcgaatgaaaagtcaacgtatccgtcgcttttaacgcttgaaggcgcgaaagagaagctggcgtatcatatcagcgaggcgaaacggatcatcagcggcctttctcttcagaaagaactgctgcatgacctctgtgatttaatcgcggcgagagatcattaaaaacggtcctgatttgaaggggctgccgctcctatggtaaaatgtaagcagtttcgatgaaaatacaaagggagtctttttcttttttcaaaaagacactgtttaatttgcagaaattcatgctgaaagtgagttgatccgctttggatcttttatcaatacaggacccgtcatttcttaaaaagatgtcaattgaacagctggaagagctgagtgaggaaatccgcaatttcctcatcacatcgctgtctgcctctggcggccatatcgggccgaacctcggggttgtcgagctgacaattgcgcttcacaaagaatttgacagtccgaaagataaatttttatgggatgtcggacatcagtcctatgttcataaactgttaaccgggcgcggcaaggagtttgaaaccttgcgccaatataaagggctttgcggtttcccgaagcgcagcgaaagcgaacatgacgtatgggaaacaggccacagctcaacatcgctctcaggcgcgatgggaatggcagccgcccgtgatattaaaggatcgaaagaatatatcatcccgattatcggagacggcgctttaaccggaggaatggcgctcgaagcgctgaaccatatcggtgatgagaaaaaagatatgatcgtcatcctgaatgataatgagatgagcattgcgccgaatgtcggggcaattcattctatgctgggacggcttcgcacggccggcaaatatcaatgggtaaaagacgagcttgaatatttatttaagcgcatcccggccgtcggcggaaaattggccgccacagcggaacggataaaagacagcttaaaatatatgcttgtgtcaggcatgttttttgaagagctgggctttacgtatttaggccctgttgacggtcattcctaccacgaactgtttgaaaacctgcaatacgccaaaaaaacgaaaggtcctgtccttttgcatgtcattacgaaaaagggcaaaggctataaaccggctgagaccgacacaatcggcacatggcacggaacggggccttataaaatcaatacgggtgatttcgtcaagccgaaagccgcggcgccttcatggagcggacttgtcagcggcaccgtgcaggagctggcgcgcgaggatgacagaattgtcgcgattacaccggctatgccggtcggctctaagcttgaaggatttgcgaaagaatttcctgagcgcatgtttgacgtcggaatcgcagaacagcatgcggcgacaatggccgcgggaatggcgcttcagggtatgaagccgtttcttgcgatttattcgacctttttacagcgggcgtacgatcaggtcgtccatgatatctgccgtcaaaacgcgaatgtatttatcggcattgaccgcgccggtttggtcggcgctgacggggagacgcatcaaggcgtctttgacatcgcctttttgcggcatataccgaacctcgttttaatgatgccgaaggatgaaaatgaaggccgccatatggtcaatacagccctttcatacgaggaaggtccgattgcgatgcgcttcccgcgcggaaacgggctcggcgttaagatggataaagagctgaaaaccattccgatcggaacatgggaagtgctccgtcccggaaaagacgcggtcattttaacattcggtacgaccattgaaatggcgctggaagcggctgaagaactgcaaaaagaaggcctgtccgtgcgtgtcgtgaatgcgaggttcataaagccgattgataaacaaatgatgaaggccattcttaatgaaggtctgccgattttaacgatagaagaagctgtgcttgaaggcggattcggcagcacgattcttgaatacgctcatgacctcggcatgtatcatacaccgattgacagaatgggcatcccagaccggtttattgaacacggcagcgtaaccgccctgcttgaagaaatcggtctcacgaaggctgaggttatgaatcggataaaactgctgatgccgccgaagacacataaaggaattggatcatgacagcaaaaaaagaacgattagatgtacttcttgtagaaaaaggccttgcggaaacgcgggaaaaagcgaaacgcgccattatggcgggcatcgtatactcaaatgaaaaccgattggacaaaccgggtgaaaaaatcgcccgggatcttccgttaacggtaaaaggaaaccctcttaaatacgtcagcagaggcggattaaaacttgaaaaagccttggaagtgtttcctgtctcggtaaaaggcaaaacgatgattgacatcggctcgtctacagggggattcacggattgcgccctccaaaacggagctgagcggtcctacgcagtggatgtcggctataatcagcttgcttggaagctcagacaggacgagagggtcgtcgtcatggaacggacgaatttccgctattccgagccttccgatttcacagagggtttgccggaatttgcgacaatcgatgtttctttcatctcactccgcctcattctgccggttttaaaaacgctgcttgtaccggggagcgattgtatcgcactggtgaagccgcaatttgaagccggacgggaatccgtcggaaaaaaaggcattgtcagagatcccggcgttcatgctgacgttctccgccgcatgaatcaatttgccgcttctgaaggatatacagtgaaaggactgtccttctcaccgattacagggggagacggcaatattgagtttctgcttcatctggaatggggcggagaagacggaaacggcgctgaactgccggaagaagatattctccgtatcgtccgcgaagcacatgagacattaaaagccaaaaagacagatgtaccggaataatagggggctattattccttttttctgccatcatgtactttttatcaagaagcggttaacataatgacaagaacagcttgaaaacagaggtgcttacatgacaaaaggccaaaggcatataaaaatcagagagcttattacaagccatgagattgaaacgcaggatgacttagttgacatgctgagagaagaaggatataaggtaacccaggcgactgtctccagagacattaaagagctgcatctcgtaaaggtgccgacgaacaacggctcctacaaatacagcctgccggcggatcagcggttcaatccgctgtcaaaactgaagcgttcattaatggatgcgttcgtaaaaattgactcagcaagccatatgatcgtattaaaaacgatgccggggaatgctcaggcaatcggcgctctgatggataatctcgaatgggaagaaatcatgggcacgatctgcggagatgacacgatcttaatcatctgcaggacgcctgaagatacggaaggcgtacaaagccgtcttttggagctgctgtagcgtaattatcagataaaaggtggaatgctgtttgttagctgaactatcaataaaaaactttgccattatagaggaactgacgatttcgtttgaacgggggctcaccgtcctgacgggagaaacaggggccggcaagtcaattattatagacgccgtttccctattagtcggcggacgcggctcgtccgaatttgtccgttacggtgaaacaaaggccgagcttgaaggactgtttctattggacagcggtcatcccgtttttgaagtatgccgtgagcagggaatagacgcatctgacgacatgattgtcatgagaagggacatcaatgccggaggaaaaagcgtctgccgtgtcaacggaaaattagtgacgattgcggctttaagggaaatcggcagacttttattagatattcacggacagcatgataaccagctgttaatggaggacgacaaacacttggagcttttggataaatttgcgggcgctgaggccgaatccgcgcttcaggcttaccatgaaggctatgagcgttatatggagctgctcaaaaaagtgaagaagctgtcagaaagcgagcaggaaatggcgcatcggttagacctgattcaatttcagcttgaagaaatcgagtcggcgaagcttgaattgaatgaagacgaacttcttcaggaagagcggaagcagatatccaactttgaaaaaatttatgaatcattgcaaaacgcctataatgcgctccgcagcgagcagggggggcttgactgggtcggaatggcctctgcccagcttgaagatatttcggatatcaatgaaccgctgcaaaagctgtctgaaagtgtgtcaagttcctattatctgctggaggatgcaacctttcaaatgcgcaatctgttagatgatctggaatatgacccggaacggctgaattttattgaaacccgtttaaatgagatcaaacagctgaagcgcaaatacggagcgacggtagaagacattttggaatacggctctaaaatagaagaggaaatcgatcaaatcgagaaccgcgacagccaccttgaagccctgaagaaggaattggagtcggtcggcaaagatgtggccgtagaagccgccaatttatcaaaaatcagaaaagcatgggccaagaaactggcggaagcgattcatcaggaattacaaagtctgtatatgggcaaatcaacgtttgatacggaatttctcgtgaaaaccgatccgtcagccagtgaagcaccggttgttaacgggcagcccgtgcagcttacccaaaaggggatcgaccttgtgaagtttttaatttcaacaaacaccggtgagcctttaaaaccgctgtcaaaggtcgcttccggaggcgagctttcaagggtgatgctggcgatgaagagtattttttcttcccagcaggatgtcacctccatcatctttgacgaagtggacaccggtgtaagcgggcgggttgcccaagccatcgcggaaaaaatccataaagtatcgaccggttcacaggtgctctgcattacacacctgccgcaggttgccgctatggcggatacgcaccttctgatcgcaaaagaattcaaagacggacggacgacaacgcatgtcacgccgctttccaagcaggataaggtagcggaaatcggccgcatgattgcgggtgttgaagtgaccgatctgacaaaacggcatgcacaagagcttttaaaacaggccggacaggtaaaaacgacaggataagctgctgatacaggcagcttattttttgttccatttctctaacagtgtatccaatgtttttcttcgtatgccggttataaatcaagcgcaggaaggcaaaagtatagatgtagcagaaaaagaaagtggtgtgggataggagcgaggagagtgaaggaatgaatgcacgataacatgaggaaagcaataggtgtaattctccttgtttctttactaagtgtaggcttttttaagccgtttaaagaatatttactgataccgtcagaaatgagcgtctttgaaaaccagacacaggccgttccggtcaatgcatcaataagcgctgaaaagggcgaattatcagaagcctttacgctgaaagaagagcacggtcatgcaaacataacagggcaaacacaaggcaggtcagaagtagtatatgatcttgccggatttcccattaaaaaaacgaaagtgcgtgtccttcctgaattgaaggtcattccgggcggacagtccatcggtgtaaaactgcattcagtcggtgttttggtcgtcggttttcaccaggtgatgacaaaggatgggaaaaagtctccgggagaacaagcgggtattgaatctggcgacatcattattaaaatgaacggacataaaattgaaaaaatgagcgacatcgccccgtttattcaaaaagcgggcaaaaccggtgaatctctggatttattggtgaaacgcgataagcaaaaaatcaaaacaaagctgattccgacaaaggacgaagccgaggggaaatatcgaatcggcctttatatccgtgattcggcagccggcatcggcaccatgacattttttgaaccgaaaacaaaaaaatacggcgcattgggccacgtcatctctgatatggatacaaaaaaaccgattgttgtagaagacggagaaatcgtccgttctactgtaacatcgattgaaaaaggaaaaggcggcaatccaggcgaaaaactggcaaggttttcgtcagaacggaaaacgatcggcgatattaaccgcaacagcccgttcggcatttttgggacactgcatcagccgattaaaaacaacatttccgacaaagcgcttccgattgctttgtcaaatgaagtaaaaaaaggacctgcgcaaatgctgacggttatcgaaaacgataaagtagagaaatttgatattgaaatcgtcagcaccacgccgcaaaaattcccggcgacaaagggaatggtattgaaagtgacagatccgaaactgctgaaaagaaccggcggaatcgttcaggggatgagcggaagcccgatcatccagaacggaaaggtcgtcggagccgtaacccacgtatttgtcaatgatccgacaagcggctatggcgttcatatcgaatggatgctgtctgaagcgggtgttgatgtttacgggaaagacaaagcaagctgactgccggatgatccggcagtttttttatgtgatgcgttcttcacttctttccgggattcatgtaaaataagacatgaagatttttcgacaaattcacgtttcctgatttgtcaaacttaatttttagtcgaaaaacctagaaaatgctagaaaaacaaagatataccactattattggtaaatatggattttttaaaaggggaagtagtggttttgtcgaatgtaacatatagcagtcaaatgggttgcgtcctgttaatacattgggggaggaagaaacgtggagaaaattaaagtttgtgttgctgatgataatcgagagcttgtaagcctgttgagtgaatatatagagggacaggatgatatggaagtgatcggcgttgcttataacggacaggaatgtctttctttgtttaaagataagaatcccgatgtgctcgtgttagacattatcatgccgcatctggacggacttgcggttttggagcgtctgcgtgaatcagagcttgagaagcagccgaacgtcatcatgctgacggcattcggtcaggaagacgttacgaaaaaagccgtcgatttaggcgcatcctatttcatcctgaagccgtttgatatggaaaaccttgtcggccatatccgccaggtaagcggaaatgtcagcagtgtcacacaccgtgcgccgtctgcgcaaagcagcattatccgcagccagccggagccgaagcggaaaaatctcgatgccagcattacaagcattatccatgagatcggtgtgcctgcccatatcaaaggctatctttatttgcgtgaagccatttccatggtgtataacgatattgaactcctcggcagcatcacaaaagtcctttatcccgacatcgccaaaaaattcaacacgaccgcaagccgtgtagaacgggccatccgccacgccattgaagtcgcatggagcaggggaaatattgattccatttcttcactgttcggatatacggtaagcatgacaaaagcaaaaccaaccaactcagagttcatcgcgatggttgctgacaagctgagattggagcataaagcttcgtaacgcaagcctttggctaaatgtctttttgcgccttctattccgtgcatgaacgcggaagagaaggcgttttgagattttgctgacgaaaacaatgggaaccactcacgccggtacttgttctatacataaatacgggaactgccgtctatacgtataataccggagctgatattttaatgattttgccgtctctgaaataaaagcgggggatgcggcggcttaacacagaaaggacttcgtagctgatcgtaccgagcatttcggcaatttcatcaacggaaatctcggctccttgttgtttgccgtagatgacgacttcttctccttgtttgccctcattctcacctaaactgaccattatcatatccattgtcactctccccgccaccggcacccgtctgccgcggtgcagaataaacccgcggttggacagggcgcgggagtaaccgtcagcatagccgatcggaatcgtcgcgatgatttcacccggttcggcgatatatgtggcgccataactgacggtccggggatctgtcaccatagctttcacataagcgatacgcgcctttaaacttagtgcgggtgtgagatccacgaggttcagttcctttatcgaggcggacggatataaaccatataacccaatacctaaacggatcatgtcggcgctgaattccgggaatgcgatagcggcggctgtattgcacatatgcacggtaggcagcgtaatgtcttgattttttaaaaagcggagaaagctgataaacttttcgtgctgcagcatcgtcagctcagtgtccggttcatccgctgttgaaaaatgtgtaaagatgccatcccatgacaggtatgtactcgacttgagcgctttcaccactgctaaaagatcttcttctgtgcgcacacccagccggcccattccggtatccacattgatatgaatggacagccgtttcgactctgcttctttttccaatatccgattcgcttttttgatccagctgacctgaaacgctgataatgtgatgttccaaacggcagattttttcacacagctgagagctgtgaagccgagcacaagaataggcgctttaattcccgctctccgtaacacaattccctcttcgacgctggcgacagcaagctcgctcgccccgctttccagtgcctgccgcgctacttccacagagccgtggccataagcgttcgcttttacgacggccataattttagacgtattcggaatatggcggcggatcgcccgtacgttcttttttatcgcatcaaggtcaacttcaatccaaacttcccggcaaagttttttcatcacgattccttctttccttaatgagattcagtactcatgctttcaatctgcattctattcatctttaactgaaatcattcaaaacatgagaaggtgaccgctgatgtttaaaatcaagttttcgggaaagcatgcgcctgctttatttatgcagtaagggcagcatggcggcccttacaatgactttacaatattctgatctgaaaattgatgttcaaacattttggactggcttacagcattgttttgaatgacaatgccgatatttccccctccggcaccgaaaacggtttttgatgcagtcagcggactgatggatatggcgccgccaacattgacaactccgtttcctgatacgttgtttatcgtaatcgggcaaccgctcattctattttttctcctttctctcacagtctactaactatatgtacgctgtgatatggaataagattaaacaaaacggcaaaaagaatccggctgctgccagccggaaagggagggaaatacggatatcataatgttttcgttacattttgatcagagtattgagagtttgaagattgagatgtgctggattgattcatttgcaggaccatacctgtatttccccctcctgagccgtagacggtttttgatacggttaaaggacttatcgaaaacgcaccgccgacattgacaaccccgtttccggaaagactgttaatcgtaatagggaaaccagccatcatatacggtctcctttctattaatctatttactatatgtacgctgtgtgttagaaataggagtaaacaaagcggtaaaaacttgtgaatcaaaaaaactgccggacatccggcagttttttagtctacttttcaaacggcacccagccgcctgtattctgaatcatttcccataacggttcaggaagtcggtatttatcaatttcagatgcctgaatggctttttcgatttcctgttcgcggccttctttgaccagcaccgcccattcggggttaatcaaaatgacacgtcccagagccaccagcggaattccgctttctaatacggcaagcgcttcgtccgcggtatagatggaaccgacggccatcagcggcactttatggccgacgcgttcgtttaataaatccatccgggtccgtgaagtatccgcgccgcggcgggctttggaattgacatccatcagtgaaatatgcagataatccaagttctcttccgcaagcgcgtcggcgagcatgaatgtttctttcattgtaagccccggtgtttccggctcttccggtgacaggcggtagccgagaacgaatggattttcagcgtgtgtatcaatcgcctgtttgacagcgtcaacgactgcaagcgggaacgcaaggcgcttttcatcgcttccgccccagcggtctgtgcgccggtttgttttcggtgaataaaattggtgaatcaggtacccgtttgccccgtgaatttcaacaccgtcaaagccggcttcaatcgctctgcgtgtcgcttcgccgaatgctttcacgatgtgctcaatttcttgttctgtgagagcacgggacgtttgtctgccgtcttcttctgagccgctcggactgacgacgtcgttgtttggcacgagttcaggagggcattccaagcctccgtggtgaatctgcacaacggctttcgctccttgagactggatcgcctgagcgagttttttcaagccgggaatgtgagaatcatcatagatgccgggctggcctggaaacgctttgccgtccggcgttacgtttgcacatgccgtaatgaccatgcccatttcttttgaacggggagtaatgtagcttaattcacggtcggaaatcgttccgtcatcatttgatgaatagtgtgtcatcggtgcgactgaaatacggtttggtatagtgacaccgctttcgaacgtaaaaggttcaaacagcggtttataagtttgcttcatcatttcgccttcttccttaggagtttaactcgtccgtattctagcttatgttttcattgtgtgcaattattttgcttgttcttcttcctgaggttatgaccggctgaaccatttaaacgaatgaaacggttttctccgttccttttcaggatctttatatcctcctgaaatttgatggccgatcgagctgaatatgacagcggcggcgaagaggagaatgatttttttcatatgcatatcttctttcttatcttttacatggttatttataagcatacgcttgtgcgaaaaaaccgtcaatttgtttattcttttttccactttcctgcggcgaatatcgttccgatctgaatcacaacacttaacagagcgcacactgccacaactgtgttgctgtccatagaagacaccctcctttttgttaggttgatgtatcatatgacggctgtctctgttttgacaaaaccgtaatgcggtgtttcatatttttcaacacaaaaagggcgcttttttaagcgcctttacttttttttcagccggttcaaagcgatttgaacggcgatggcgtcatccaggtagccgatcggaaacatgtaatccgggataacgtcggtcgctaaaatataatacagcagcgcgctcccgagaatcgcgcggtcttcagccggtgttgattcatccatatactgatgatgcatgtttttcaaatggtcaataaaagggccgacgctttcttcattgtccattttcttttgaaactcatcgcaaatcaggcgatggccctgctgggttttggcgtattgttcatatctggtcagttcacgctcaatttgctcccgggaaaaaggctgatcaaacatctcggccatattcagcatatcctgaatcgcgtgcatcgggtcttgcggcgcagcttctttttcatggccgatgtctatgcctgacgcctcaagcaattcctccagcggggtgcggaggtgttttgaaaattcctgaagatgctttaaattggccttctgtttgccgttgataatccgggagatagtggccgtatcaatgtttgttaaggcgccgagttttctcatggagagcgagtgcttatcaagcagtgattttaaaaggggtcccagtgtcttatttttattttctgtcaagggtgtcacctcgtttccgccggaatgatgatcgtcaatcaataatttttgcagaaaaggtaccttttctgtgctgctgaataggatagtgtagattcaacggcacaacatgttgaaaagacatcaaagaatggagagaaacgaacatggcttggttattgattttaggtttggcagtgtcctcaagcattgataatttaggagtggggatgtcatacggcatcagaaaaatcaaaatatcgcatgcgtcaaatatgatgatcgcttttatctgttttgtattcagttatatcggaatttatttcggcaaatggatttcagccgttttaccgggctttcttcctgtattgctggcggcgtttattttatctgtcatcggtatccgcatcattctgctggctgtgccgagaaaaacagcgcgtgttggcgggtcaggaaaaaaaggccgttttgccggtctgctgcaaaatccggaggcagcggatgccgacggttcgggagaaatcggtatattggaatccttggttctcggggtggccgtatccgcaaatgcgctgaccaacggattaagcgcggggttgatcgggctttctcccgctgccatttccattactgcggcggtcggaagctttctgaccatatggatcggctgctcgcttggaaaaaaagccgcttcattgcgcatcggttcttttcacgtcggacagttcagcacggtgctgagcggagtgattattctcatcattgccgccaatacgctgctcttttaagttgtcccgttcattttatgaaaagctcaaaataaatatgaatgtttctattcgggagagtgcatgacgcggctctcttttttgccgatctgatattttttcaaaatgaacagaaagtcgtccgtttccgttaaattctgcatattcggccttcagacagaacctttttcatagactgatcagcttgttttctttctaagttcaggtaaacagcaggtcagatagccttcattccaaagatggaaaaacgctggaggaatggaggctccctttacaaatcggccattctgttcaaagataaagccgaatgagaaaacgtgaggtgatctgtgtgaagtctgccatacttctgatcttcaccgcatggctgttatcaggctgcgagtataccgcggaggctgatgcggcgccgtcatttacacaggaaggaacatttataaaagcggccggaaacgatacgatcgcggtcgaaattgacggagaaaggcaagaggtgaaggtgcctttcgctaagcggtttgaatgtcagtcgctgcctgaacatacggcggtgcaaatcacctataaaaaagagagcaacggacaattacggcttgagaaactgaaaaaagaaacagatatgtgaaaacggggaggaaaaaaacgtgggtttactgacaaaaagcgctgctgccttcggtgccgctctgcttctgcttgcgccgtccgcttatgcagccgaacctttgcaagggaaaaccatctatatagatgccggacatggcggagaagacagcggggccggcggaaatggactgcttgagaaaaacatcaatttagcggtgtcaaacaaggtgatcgccaaattggagacagaaggcgcaaaacctgtagcttcaaggactgatgatacttttttacgtttggacgagcgggtggcgaaagcgagcgccagccaatccgatttattcgtcagcctccataccaattcagccgtatcaacggcatcgggcgcggaaacgtattttaattcgacatatgaaggagcggacagcgaaaggcttgcttccgacattcagcagcagcttgtcacgtctttagggatgagggacagaggcgtaaaagaagctcctttttatgttattacatattcaaagatgccgagtgtgctggctgaattaggttttatcacaaatcctcaagatgcggacaagctgaaaagcgataacggacaagagcacgccgcggacgccgttgtaaacggaatcgaaacctattacagcggacggtaatgataaaatatgtgtaaatagcgccctcctgatgtgcataacgattataatagagaaaaccgatgacaaacatctgaggtgacacatatgacgaatatttttgcccaccggggggcgtcgggcgactgccctgaaaatacgatgcccgcattcaaaaaagcgattgaggacggggctgacggaatcgaacttgatgtacagatgacaaaagacggccggatcgtggtcattcacgatgaaaccctcgaccgcacgacatctttgaaaggatttgtgaaagatacggcgtatgacaaaatcagaaccgccgatgccgccggaaaatggaaagattcttttaaaggtgtcagaattccgcttttgtccgatgtgctgcgttttgctgaacgtgctgattttctgataaacattgagctgaaaaacagtgtattccgttacgaaggaatggaagaagaagtgatcaaaaaagtcagatattacggactggaaaagcgcgttattttttcttcatttaatcatgagagtctcgcggtgtgccacgccctggcgcctgaaattgaacgggcggtgctgacaatggatgtgctgtaccggcctgaacgttatcttgccgccattcccgcttcgggttatcatccgaagctcggcacgccggcggtcagcgctgaagtgatcacacatcttgcaaaacaccaagcggcgctccgtccgttcaccgtcaatcgtcctgaggatatgaagcggctgatgaaagcggggatagacgcgatttttacagattatccaaagctggctgtttctataaaagaagaatgccgcagctgagaagactggtcagacagtcttctttttttatgggcgggaaaaaggcggtgcactcataactcggtcagccggttcatatattgtaacagggcgttttgtgtaagcgttatcttttatcttattgaaagtgaggcaaaattgtgggaaaaacggttatcgtcagtgcggcaagaacgccgttcggaaaattcggcggcgcattaaaagaggtgaaggcatccgagcttggcggcattgccataaaagaagcaatcaagcgcgccgctatcagtgaaagcgaagcggaaggagcggtgatggggatggtcgtccaggcgggtgccgggcaaattccggcacggcaggctgcaagatatgccgggcttccgtggtctgttccggctgaaaccattaataaagtctgtgcatcagggctcagagccgttaccatctgtgatcaaatgatccgggcgaaagacgcggacgtgctgattgcaggcggaatggaaagcatgagcaacattccgtacgccattccggccggccgctggggtgtgaggatgggggacggggtttttcaggatttaatggttcatgacgggctgacctgtgcgttcgaccaggtgcatatggctgtccacggaagcactgcggccaaaaagtacggcatttcccgagatgaacaggatcattacgctcttttgagtcagaaacgcgcggctgaggcggctgatgcgggcaaattgcgtgaagaaattgtccccgtcacctggaccggcaaaaagggcaaacagcatatcgttgaagcggatgaggggctgcgtcctgatacaagccttgagcagctcgcagcgctcaagccgattttcacagccgacggaacggttacagccggaaacgctcccggtgtaaatgacggggccggagcatttgtgctgatgtcagaggaaaaagcagcaaagcagcatgtcaggccgctcgcagcgatacttggctttgcgtccgtcggactggaagcgtccgagctggcaagcgcgccgggagaggccatcagccggctcttgaaaaaaaccggactgtccgttgacgatattgatttgtttgaagtaaatgaagcatttgcgtccgtcgtgctcgtgagtgaaaaaatagccgggttcagccgggagaaagtgaatgtaaacggaggggcaatcgcgttcggccacccgatcggcgcaagcggagcgagaatcgtcatgagtttaatatacgaattaaagcgtcgcggaggggggttaggcatagcggctatatgcagcggagcggctcaaggagatgccgtcctgctggaggtgtactgatcaaaggagggagcgccggatgaagatgaaaacaatcatggtcgcaggtgccggtcagatgggggcaggcatcgctcagacggctgcagaagccgggtttgccgtcaagttatacgattgggagccggaaacggtaacaaaaggtcttcaccgcataaagacaaacctggagaaagagcaggcaaaaggacggaagtcacagcaggagacagatgccgttttcagccgtatttccccggcggagctcacagaagcgggagatgctgattttatcattgaagccattgccgaaaacaaaaaagcaaaagcggaattgtttgacacacttgataaaatctgtccccctcatgccgtattggcaagcaatacgtcttctcttcctattacggagcttgccgcggccacaaaaaggcctgaaaaagtaatcggcatgcattttatgaatccggttccggtcatggagcttgtcgaagtcatcagaggactcgccacatcggaagaaacggcggaaacagtaaagaagcttgccgtccggatgaataaaacccctgtcgaagtcaatgacttcccgggctttatatctaatcgcatattaatgccgatgattaacgaagccgtttattgcctttacgaaggagcagcttcaaaggaagcgattgatgaggtgatgaagctcggcatgcgtcatccgatgggtcctttaacattagctgacttcatcgggctggatacgtgcctttccattatggaggttctctacgcggggctcggagatccgaaataccgcccatgccctctgctcagaaaatatgtcagcgccggctggctcggcaaaaaaagcgggcgcggtttttatgagtacggcagatgacgtaaagatcatgaggggagacggcagccatgcattttactgaagagcacatcatgatgaggaaaatggtgcgtgattttgcccgcaaggaaatcgcaccgatggttgagctcatggaatcaacagatgaatttccggagcggctgattaaaaaaatgggcgaagcgggattgatgggcattcccgtcccggaagcttacggcggggcgggtgctgatacaacatcttacattttagcgattcatgaaatatcaaaagtcagcgcggccgtcggcgtcattttgtccgtccacacatcggtagggacaatcccgattttgcatttcgggacagaagcccaaaaacaaacgtatattccgaagctggcagcgggcgaatatattggagcttttgcgcttactgagactcactccggatctgatgcgggaagcctgaaaacaacagccgtgcgaaaaggcggttcatatattctgaacggttcaaaaatctttattacaaacggcggagcggcagatctgtatctgacatttgccgtaaccgatccgggtaaagggagaaagggaatttcagcgtttattgttgaaaaaaacacacccggtttttctgtcggaaaaaaagaaaaaaagctcggattgttaggttccaatactgccgaattgcagtttgatcaagcggaaattccgattgaaaaccggctcggcgaagagggcgagggtttttcaatcgccatgaaaaaccttgacgtcggacggatcggcatagcggctcaggcgctcgggattatcgaagcggcgctcggctgctcggcggagtacgccaaaacccgcagccagttcggcagacccatcgcttcgaatcaggccgtttcatttaaattatctgacatggcaacgaatgcggaagctgccaaattattggtctatcatgcggctgatctgtatcagcgagggcttccgtgcggaaaagaagcatctatggcgaagcaattcgcgtccgatgcggcgatgaaagcggcggtggaggctgtgcagattcacggcggctacggctatatgaaagagtatcccgcggagcgtttatttcgggatgcgaaagtcacgcaaatctatgaaggaaccaatgagattcaaaggctgattatttctaagtatcttcttcaataaaaagtgcgcaaaggagcgaaactatggaatcttattctcccggtttagatggcgtcattgcggtggaaacggggatttctttcctggatacacagcagggcagtattttaatcaaaggccacgatctgattgagctttctaaaacggccggctatatggacattgttcatctcttattggaagacagacttcctgatgcgaaagagaagaaggcgcttgaagaagacgttcggcgcggcggacaccttcccgaggaaatcttgcgtatatgccgtctgctgcccgaacgtactcacccgatggacggactgaggacaggtttgtccgcgcttggaggctttgataaggatattgataaccgcacctcttctgtaaatcggcaccgtgtccgcgggctgataggcaaaatgcccaatctgaccgtcaacagctatcgagtcatcaacggactggagcctttagcgcctgtcggaaccttgtcgtacagcgcaaactttttatatatgattaccggaaaaacgccgtcctccttggaagaagaaatattcgaccggtcgcttcttttatacagtgagcatgaattgccgaactcaacgtttacggcccgtgtcattgcttcgacgcaatcggatatttacggcgctctgaccggagcagtcgcctcgcttaagggaaaccttcacggcggagcgaacgaagcagttatgtacatgcttgaggaagcgaaggatacagacgggtttacacaattattaactcaaaaactcgcaaacaaagaaaaaatcatgggcttcggccaccgtgtctacatgaaaaaaatggacccgagggcgctcatgatgaaagaagcgttgaaaaaactgtctgatctttcaggtgatttccgtctttatcatatgtgtgaagcaggagaaatcgtcatgcgggagaaaaaaggcctttacccgaacttagattactacgcagcgccggtctattacatgctcggcatcccgatcccgctgtatacgcctatattcttcagcgcacggacggtcgggctgtgcgcccacgtcattgaacagcacagccgaaaccggcttttccgcccgcgtgtccgctataccggagcgcgtctgtaaacagatgagaaaggaagatgaaaacatgacagaaccccgccgaatggacgccgtaatcgaagagatttctgactacgtgctccatcaggagattgacagttcggaagctttcactacggcaggacatgtgcttcttgatacgataggctgcggaattttggcgctcagctatcccgaatgtacaaagctgctcggcccgattgtcccgggaacctccgtgcccaacggcagcagagtcccgggcacgccttttgttttagacccggtcacggctgcctttaatatcggctgtatcaacaggtggctcgattataatgatacgtggcttgcggccgaatgggggcatccgtctgacaatctcggaggcatattggcttgtgcggattatatatccagagtgcggatttcagaagggaaagaaccgcttaccgtgcgtgatgtgctttgcgcaatgatcaaagcgcacgaaattcaaggaattctcgctttggaaaacagtttaaacagagtcgggcttgaccatgtgctgtttgtgaaggtggcgactgcggctgtttgcgcacaaatgctgggcggctcaagagaggaaatcaataacgccgtatctcacgcttggattgataattcaagcctcagaacgtatcgtcatgcgccgaacaccggatcacgcaaatcatgggcggccggcgacgcgacgagcagaggcgtatatttggcccttatggcgcaaaaaggtgagatggggtacccgacggctctgaccgcatccgggtggggatttcaagacgtattatttaaccggcaggaaatgaagcttgcccgcccgcttgggtcctatgtgatggagaatgttttgtttaaagtatcctatccggctgaattccacgcccagacagcggcggagtgcgcggtccggcttcatccggaggtgaaagaccgcatcgaagacattgacaggatcacgattatgacccatgagtcggcaatccggattatcgataaaaaagggccgcttcacaatccggctgaccgggatcactgcctccagtatattacggcaatcgggctgcttttcggagatatcacggcggatcattatgaagaggaaacggcgtctgacccgcgaattgatacattgcggagcaaaatggaggtgacggaacataaagcgtactcaaaagattacttagacccgaataagcgatccatctcaaatgccgtacaggtgcattttacagacggcacggctacgggacggattgaatgtgaatatccgctcgggcaccggttccgcagaaaagaagccgttccgaagattcttgccaagttttcagcaaacatcagcactcatttttcattgaagcagcagcggaaaatcgaagaggcctgtaaagatagcggccgaatgcagaagctcagcgttagtgaatttatggacttatttctcatataaaataggagggtgacaaacatgacgtggatcgtcagcaagcagtcgtctcaagaggagcttgcagagcggttccgtacgctgatggcagcgccggatctattgcagattccaggcgctcacgatgcgatggccgctcttattgccaagaaaacgggtttttcggctctttatttatcaggcgcggcttacacggcgagcagagggctgcccgatttaggcatcatcacgtcggcggaaatggctgaacgggttaaagatctggtccgctcgtctgatctgcccgtccttgtcgatattgacacgggtttcggaggcgtgctgaatgccgcccggacggcgaaagaaatgtatgaagcgcgcgcggccgccgtccaaatggaggatcagcgcctgccgaaaaaatgcggacatctgaatgggaagcagctcgtgccgattgaagaaatggcgcaaaaaatccaagcggtcaagcgggccgcgccgactcttcttgttgttgcgagaacagacgccagacagcaggaagggctggagggggcattaaaaagggcgtccgcttatataaaagcgggtgctgacgctgtttttccggaagcgctccaatacgaaagtgaattcagagcgttttccaaacaaatcagtgtgccgattctcgcaaatatgactgaattcggacaaacgccgtattacagtgctgatgaattttccgatatgggctgtcagatggtcatttacccggtcacgtcactcagaacggctgccaaggcttttgagcgtattttccgccttctgaaagaagaaggctctcaaaaagaggggctttcggatatgcagacgagaaaagaattatatgaaacgatcgcttacgatgactatgaagaactggatcaatccattgccaaaacgatactgccggacgactgaaaaagcccttttttgcaagggctttttttacagcttttttttcctgaaccgcgggctgacttgattgcgtttccgatctctgtacaaaataaacccggccagaacataaaggccgaacaaaaaaaacgccaatccggccgccccctgaagaaaaagggacggaaacggggaaaacgcatgcccgaataatgcatctctcatcagtttaatgccgagcgccgcgacagcgccggggaggaccagaatcaaaagcgcaacaagccggctcatattcagaaaacccctttacgatatgatttcctttattgtccaatcgaaaaaatattttgtcaagagatcaaaacgtggtaacataggggttgtgcaaattattgcaacgggaaatacaggtgtgcaaattttttcatataaaggggtatcgggatgcagaaggtgctgattataggtgctggtaaaggaggcacggcgctcctacagattttgatgaaaacaaaactgatccggattattgcggtggttgatcaagatccggaggcgcaagggctgcaagaagcccggagatatggaattgcaacctcatcagattggaaaccctacataactgaagatatagatattatcatccatacaacaggcgataaagcggtcatggatgagctgctccatgagaaaaaagaacaaaccatcgtcatgccgggaaaattggcgtacatggtgtttcagctgatggaggaaaaacagcagcttatccaaatgctgaagtcgcagacgtataagcatgaccggatttttaattcaacgcacgacggcatgatttttatagacgtcaacgaaacgatcattttatttaatcagatggcagaaaaaatggtcggccgaaaacgggaggatgtcatcggccgccaaattaaagatgtagtgccgaacacaaagctgccgcggattctggaaacgagagagccggaatataaccagaagcagcttctcggcaagcacctgcagattgtcacgacaagactgccgatcattgatgaaggcggaaaacttctcggcgcgttatgcgtgtttaaagacatcaccgacgcagttgaactggcggaagaggtcacgaacttaaaacaaatccgcaccatgcttgaagcgattattcaatcgtcagacgaggccatttccgtcgttgatgaaaacggcatcggaatgttaatcaacaaagcatatacaaaaatgaccgggctgtcagaaagcgaagtcatcggaaaacccgcttccaccgatatctcagaaggggaaagcatgcacctgaaagtattggggacaaggcggcccgtgcggggtgtgaggatgaaggtcggccccaataaaaaggatgtcatcgtaaatgttgcccccgttattgtggatggtattttaaaaggcagcgtcggcgtcatccacgacgtgtcagaaattaaaacgctgactgctgagctgaatcgggcgcgccagatcatccgcacgcttgaagcgaaatacacgtttgatgacattatcggcacgagtgaacaaatgctggttgcccttgaacaggcgaagctcggggcgaaaacgccggcgacgattctgctgcggggagaatccggcacagggaaagaacttttcgcccacgccatccataatgaaagcgaccgaaaatacaataaattcattcgggtcaattgtgcggccctgtctgaatccctgcttgaatccgagcttttcggctatgaggaaggcgcgtttacgggcgcgaggcgcgggggcaaaaaaggactttttgaggaagcgaataacggcagcattttcttagatgaaatcggagagctgacccaaagcacccaggcaaagctgctcagagttctgcaggaaaaagaaattatcagagtcggcggcgcaaaagcgatttctgtcaatgtcagaattatcgcagcgacaaacgtcaacatcgaaaaggccatggcggaaggcgcgttccgcgaagacctgtattaccggattaaccgctatccgatctcaatcccgccgcttcggcagcgcaaagaagatattgaagcgctgagcattcggctcattgaaaaaatcaatcaggattacggccgcaatgtaaaggggctcacgccgaacgcgctgcgagctttatcagcctacagctggccgggaaacgtacgggagcttgaaaatgttctcggacgggcaatgatatttttagagccgcatatggaacggatcgaacagcagcatctgcctgttttcgaatcagagctgaatgacaaaaacggcacccaaagtgattttccggatgtagaaggggaaaagctgtctcaggctgttgaaaaatttgaagcgcacatcattcaaaaaacgcttgaaaagcataaattcaaccgaaccaaaacggcgaaagcgcttggtgtcagcattcggaatctgtactacaaaatggacaagtacggccttgcaaatgacggcatgcaataaattgcagagaaagcgcaaaccgctgcatgttttcttgaaaaaagccggaataaaccctttcgcatatttggcacagaacttgcattgttaaaagcggattcgcacaagaaaggtggtacaaaatgaagctgagagacctagttgaaaaagccgcggcaaaaaacgcaaaaaccattgcagtggcccacgcagcagataaagaagtgatccacgccgtcaaaatggcggcagaacacttgtcggcacgatttttactgacgggtgacagcggaaagctgaaagagcttctggcaaatgagccgaagttcaatgctgacatcatccacgccgattcaccagaagaatctgcggcaaaagcagtgcgcgcagtgcgtgaacaagaggcggacgttttaatgaaagggaatctcccgagctcaactcttctgaaatcggttttaaaccgccaggaagggcttcgttcaaaaagggtgttatcacatgtagccgtttttgaagtgccggactatgaccggctgatgtatgtgactgattcagcgctgaacattgccccgtctcttgaagagctcgggcatattctgcaaaatgcggttcatgtcgcacattcagtagggaaccctatgccgaaagccgcagtccttgcggctattgaaacggttaatccgaaaatggaggcgacgctgaacgcggctgcgatcgtccagatgtgcaatagaggacagattaccggctgcattgcggacggaccgcttgctttggataatgccgtatcccaagcggctgcgctgcaaaaagggatttccggaagcgtagcgggccaggcggatattctcttggttccttcaatcgaggccggaaatatgctttataagtcaatgatttattttgcgaaagcaaatgttgctgctgtcatcgccggtgcaaaagcgccgattgcattaacgagcagagcggataccgcagaaaataaactgtattcaattgcgcttgcgatttgcgcatcacaagaacagtaggaggaacgaacctatggaaatttttaaatatatggagacttatgattacgaacaattggtattctgccaagatgaacaatccggattaaaagcgatcatcgcgattcatgatacgacgctcggccctgcactcggcggaacaagaatgtggacatatgacagtgaggaagcggcgattgaagatgcactgagactcgcaaaaggcatgacttataaaaatgcggctgccggtttaaacttaggcggcgggaaaaccgttattatcggagacccgcgcaaagataaaaatgaagaaatgttccgcgcgttcggccgctacatccaaggcttaaacggaaggtatattacggcggaagacgtcggcaccaccgttgaagatatggacatcattcatgatgaaacagactatgtaaccggaatttctccggcattcggttcatcaggaaatccgtctccggttacggcgtacggcgtctacaaagggatgaaagccgcagcgaaagcggcgtttggcactgattcactggaaggtaaaacaattgccgtgcaaggcgtgggaaatgtggcttacaatctatgccgccaccttcacgaagaaggcgcttctttaatcgtaaccgatatcaataaagaatctgttaaacgtgccgttgaggacttcggcgcccgcgccgttgatcccggcgacatttactcacaggcgtgcgatatttatgccccgtgtgctctcggcgccgtcattaacgatgacacgattaaacagctgaaggcgaaagtcattgcgggggcggccaataaccagctgaaagaaacacgtcacggcgataccattcatgaaatgggaatcgtgtacgctccggattatgtcatcaatgcaggcggcgtcatcaatgtggccgatgagctttacggctacaacgctgagcgtgctttgaaaaaggttgagggcatctatgcaaacattgagcgggtgctcgatatttccgcgcgtgacggcattccgacatacttagcggccgaccgtctggctgaggaacgaattgagcgcatgcgccgttcaagaagccagtttctgcaaaacggccaaagtatattaagcagacgataggaatttgatctggaggtatgaaaatgttcgaacaggaaaaacgcattctcattctgaatccaggctcaacatcaacgaaaatcggtgtctttcacaatgaacgctgtatctttgaaaagacgctgcggcatcccgaagaagagctgaaagcatttaacggcattatcgaccaatacgaatttcgaaaaataagcattcttgagtctttgcacgaacagggcatcaacatttcaaagtttgatgccgtttgtgccaggggcggcctgctcagaccgattgagggcggcacatatgaagtgaatgacgccatgatcactgatttgaaaaacggctacaacggccagcatgcttctaatctgggcggaattattgccagggaaatagcagacggattaaatatccccgcgtatatcgtcgatccggtcgtggtggatgagatgactccgctcgctaaagtatcaggaatgcctgaaatcaagcggaaaagcatttttcatgctttgaaccaaaaagctgttgcccgtcatgcggcggcgtccctcggcaaacggtatgaacagatgaagatgatcgtcactcatatgggcggcggcatcacagtcggggtccatgattgcggacgggtgacggatgtcaacaacgggcttcacggagaagggcccttcagcccggagcgtgcgggaaccgttcctgcgggtgatttggtggagatgtgtttttccggcaagtattcaaaagccgatatgatgaaaaaacttgtcggcacgggcggactctccggctacctggggacaactgacgcggtgaaggtggaaaaacgcattcaggccggagatgagcatgcgaggctcatttatgacgccatggcttatcaagtagcaaaagaaatcggggcggcaagcgccgtattaaaaggaaaagtagacattatcgtcctgacgggcggattggcgtacgggaaaagtttcgtatccgccatcagatcgtacatagattggatttcggatgtactggtgtacccgggagaaaatgaactgcaatctctcgcgcaaggcgcgcttcgggttttagccggcgaggagcagtcaaagcaatatcagatcggcgaaggagtgaaaacaaatggcgactgaatatgatgtggtcattctgggcggcggcacgggcggttatgtagccgccatcagagcggcccagctcggcttaaaaacggccgttgtagaaaaagaaaagctcggcggaacatgcctgcataaaggatgtatcccgagtaaagcgctgttaagaagcgcggaagtgtaccgaaccgcaaaggaagcggcagcattcggcattgaaacggaaggtgtctccctccgctttgacagcgtgcaaaaacgaaagcagggaatcgttgaccggctggccggcggtgtcgcccacttgatgaaaaaggggaagattgatgtattcaacgggtacggacgtatgctcggcccttccatcttctcacctcttcccggtacggtttccgtcgaatacgcaaatggtgaagaaaacgacatgctgataccgaaacaattgattatcgcaaccggttcaaggccgaaaatgctgccgggtttagaagcagacggtacatatattctgacatcagatgaagcgcttgagcttgagcgtctgccccaatccatgttgatcgtcggcggcggtgtcatcggaattgaatgggcatccatgctgaacgatttcggcgtcaatatcactgtgattgaatatgcggaccgcattttgccgactgaagaccatgatatttcaagcgagatggaaaaactgttaacgaaaaaaggaattaagattgtaacgggtgcgaaagtgcttccggatacattggaaaaagcggatggcgtttcaattgccgctgaaaagaatggaaaaaaagaaacgtatcacgccgaacaaatgcttgtttccatcggccgccagccgaacattgaagggatcggtcttgaaaacacggacattgcagcggaaaacggttctatcatagtaaatgaagccggacagacgaaggaatcgcatatttatgcgatcggtgatgtcgtcggcggtctgcagcttgcgcatgtggcctcccgtgaaggcatcattgccgttgagcatatggcgggtcttaatccggctccgcttgatgccgctcttgtgccgaaatgcatttattcaaatccggaagcggcgagtgtcggtctgacagaagaagaagctgcccgaaaaggacatgaacttaagatcggaaagtttccgttcatggcaatcggaaaggctcttgtatacggagaaagcgatggctttgtcaaaatcgtcgccgaccggaatacagatgatattctcggtgttcatatgatcggcccgcacgtcaccgatatgatctctgaagcggggcttgccaaggtgctcgacgcgacgccttgggaaatcggccagtccatacatccgcatccgtcgctttcagaagcgattggggaagctgcgttagccgcagacggaaacgcgattcatttttaaaaggaaagaaggaggggtttgaatgactacaaaccgccatcaagcattagggctttctgacgaagaagccgttgaaatgtatagaaccatgctgttagccagaaaaatcgacgaaagaatgtggctcttaaaccgctcgggcaaaattccgttcgttatttcatgtcaagggcaggaagcggctcaagtaggcgcggcctatgccctaaaccgcgataccgactatgtgcttccgtactacagagatatgggggttgtgcttgcattcggtatgactgctaaggatttgatgatgtcgggttttgcgaaagcggctgatccgaactcaggcggaaggcagatgccgggccacttcgggcaaaaggaaaacagaatcgtaacgggctcatcccctgtgacgacgcaggttccccacgcggtcggaatcgcgcttgcgggacgcatggataaaaaggatatcgtctctttcgttacctttggagaaggttcttccaaccagggagattttcacgaaggggcaaactttgccgccgtgtataaattgccggtcattttcatgtgtgaaaataataagtatgccatttccgttccgtatgacaaacaggtggcgtgcgaaaatatttccgaccgggcggcaggctacggcatgccgggagtcacagttgacggaaacgacctgctggaagtttaccgggccgtgaaagaagcgcgcgaacgggcatctaaaggcgaaggtcctacattaatagaaacggtttcctaccggttgacgccgcattccagtgatgacgacgacagcagctacagagaacgcgaagaagtagaagaagcaaagaaacaggatccgcttcttttatacaaagcatacttgcaagaagccgggcttctaggtgaagaagaagaaaaggccatgctggatgacatcatggctatcgtaaacgaagcgacagacgaagcggagaaagcgccatacgcatctcctgaatcaacgcttgatcacgtttatgcgaagtagggaggaatacttatgtctgtaatgtcttatattgacagtattaatgcagctatgaaagaagaaatggaaagagatccgcgcgtttttgtcctcggggaagacgtcgggagaaaaggcggcgtatttaaagccacggcgggtctctatgaacagttcggagaagagcgggtgatggatacgccgcttgcggaatcagcgattgcgggtgtcggaatcggcgccgcgatgtacggcatgcgcccgattgccgagatgcagtttgccgatttcattctgcctgcggtcaaccaaatcatttcagaagcggccaaaatacgctaccgttcaaacaatgattggagctgtccgatggtcatcagagcgccttacgggggcggcgtgcacggcgcgttgtatcattcccaatctgtggaggccatttttgccaaccagccgggtcttaaaattgtcatgccttcaactccttatgacgcaaaagggctgttgaaagccgcagtccgtgacgaagatcccgtgctgtttttcgaacataagagggcgtaccgcctgattaaaggagaagtccctgctgatgattacgtccttccgatcggaaaggcggatgtaaaacgcgaaggcagcgacattactgtcattacgtacggattatgcgtccatttcgctctgcaggctgccgagcgtcttgaaaaagacggaatttccgcgcacgtattagacttgcgtacggtttatccgttagataaagaggctatcattgaagccgcgtctaaaacgggaaaagtattgctgatcacagaagatacgaaagaaggcggtattatgagcgaggtcgccgccattatttctgaaaactgcttatttgatttagacgcgccgatcaagcggcttgcaggccctgatgttccggcaatgccttatgcgccgacaatggaaaaatacttcatgatgaatcctgacaaagcggaagccgcgatgagagaattagcggagttttaaagacgtaaggaggtttttgacatggcgattgaacaaatggctatgcctcagctcggagagagcgtgacggaagggacgatcagcaaatggctggtatcccccggtgatcaagtgaataaatatgaccccatcgcggaggtcatgacggataaagtgaatgcggaggtgccgtcttcttttaccggtacgattacagaacttgtaggagaagaaggccagactcttacagtcggcgagatcatctgcaaaattgaaacggaagaaacggaaaccgaagaggcgccgaagcgggaagaagagcagaataccccttcagacaccgatgcaaaccgtcaaggtaaagaccagtcaaataaagcgcgttattcgccggccgtgctcagattagcgggagaacacggcattcagcttgaagaagttgaaggaacgggcgcaggaggaagaattacgcgaaaagacattcaaaagatcattgattcgggaatgcagcagaagtcggaagcaccggcgccggctgccgttcaaacaacgcaacaagcgccgaaacaacagcaaaaacaagcgccggcgccagttctgtcagccggtgatattgaaattccggttacaggcgtcagaaaagccatcgccgccaatatgcataaaagcaaaacagaaattccgcacgcctggacgatgatggaagtcgacgtcacgaacatgacggcgtacagaaacagcataaaagactcatttaaacaaaaagaaggcttcaatttaacatttttcgctttctttgtaaaagcggcggcgcaggctctcaaagagttcccgcagatgaacagcatgtgggcgggagacaaaatcgtccaaaagaaagacatcaacatctccattgccgttgccacggaagattcgctgtttgttccggttattaagcatgctgatgaaaaaacgattaaaggcatagccagagaaataacggaccttgcgaaaaaagtgagaaacggaaaacttaccgcggaagatatgcagggcggcacatttaccgtcaataacacgggatctttcgggtcagttcaatctatgggcattatcaaccatccgcaggcggcgattcttcaggtagaatctatcgtcaaacgtccggttgtcatgaataacgggatgatcgcagtgcgtgatatggttaatctttgcctgtctttagatcacagagtgctcgacgggctcgtatgcggccgtttcctcggacgcgtcaaagaaatcttagaaaacattgacgaaaatacttcagtctattaaaaaaactccttttgcccgggcggcaaaaggagtttttttattttcattgtgaatcctcgggaacaagcatagtgagatgatgttttttcacttcgatcgtacaaggcgttgttccgtatacctcgccatctgtatccgcgtccatttcacgtccggtttcgatttcaatcctggaggcctgaatataggacagctcccctttgaaatcatcaaacgaaccctgctccatcgtcatcagctcccgcaacgcggcaaggcttgtgttgcggcagattaacacatcggctaagccgtcccggaggctcgcatcaggcaggggaactctgtttgtcccgatataatgcccgttcatgacaagcaccattacggcttcgtcttctttcacctcgccgtcaattgtcaatttgacaggaaacgggttcgcacttgtcatcgtccgcaaggcgctcgtgaagtagctgattttaccaagccatgctttttcagtttcattgatatggctcgatgcttcggtgatcaatccgatgccccagaagttcagaaaatagccgtcatccgttttacagacgtcaatcatccgtttatgtccggccgcgagcgcttcagcggccttttgaaggttttgcgggatgccgagcgcccgtgagaaatcgttgcacgttcctcccggcaaaatgccgacagcgggcctgttatcaagcttgctgatgctgttgatgcattgatgcacagtgccgtctccgcctaaaatatataaatggtcaactgaactgtcgaggttttcacaatactgacgggcatcgtcctgatgtttggtcggtttaatcaaaagttcgtcagctgactgggccaaaatggggacgaccgtgccgagcgttttatcaatctgtttttgaccggcgtttccgttataaattaatactgctttccgttggctcatacgactgctcctttatttcagacaatctctttaacaagtttcccgtttttaaaaggtcataaacttacatcaggtacataaaaggaacaaaaaacaatttggatatgagcggtgtcatttgccgatagtgaggttccttgctatcataagaaaagatgatcaaaaaggagaggtcccagttgaatatggattttaatttatttatgaatgatgtcgtgcgtcaagcccgccaggaaatcacggccgccgggtatacagagctgaaaaccgctgaggaagtggacgaagcgctttcgaaaaaaggaaccacactcgtcatggtcaactctgtgtgcggatgcgcaggcggtattgcacggcctgccgcataccattctgtacattacgataaacgcccggatcagcttgtgacggtatttgccggacaggataaagaagcgacagccaaagcgagagaatactttgaaggctatccgccgtcctctccgtcatttgccattttaaaagacgggaaaatcatgaaaatggtggaacgccatgaaattgaaggccatgagccgatggccgtcgtcacaaaactgcaggaagcatttgaagaatattgtgaagaagtataagtgaaagaaaaaccccggagccgagcgcttccggggttttttatatggaatctgtataaatataaatatttatacaccggcgttcagctgtcactaatcggaaaaacaatgactataataaacagagaaaggaaaatatatttttcaaaaatagtattgcatcacaattaaaaagtgtttaaaatacaagttaacgaataaatattcaattttaagagatcagtagatatgggggaaatgaatcatgaagaaatggctgttggtattagctgccgcatgtatcacctttgcgctgtccgcctgcggatcaggcaattcaggctcagagggcggaaagaataagctgattatgggtacatcggctgactataaaccatttgaatataaagacggcgatcagatcaccgggtttgacgttgatctggcaaaagctctgggcaaaaagaccggctatgacgttgaggtgcaggacatggacttcaacagcctgattacagccttgaagtccaagcaggtagatatgattttatctggaatgacacctacgccggaacggaaaaagcaagttgatttttctgatatttattatactgctaacaatatgattgttacgaaaaagggaagcagcattaaatccctgaatgatctgaaaggcaaaaccgtcggtgttcagctcggctccattcaagaggaaaaaggcaagaagctcgcttcgaaatacggttttcagctcgaagaccgcaaccggatctcagacttaacggaagagattaaatccgggcgttttgatgccgcgattatcgaagacatcgtagcacaaggctatttcagttcaaataacgatctgcagggctttgcgtcagcagatgcgaaatcagacgaatcgggctccgcgattgcgttccgcaaagacagtgatctgacagcgaagtttaacaaagcgctgaaagaaatggagaaaaacggagaaatcgaaaaactgaagaaaaaatggttcaccaacgagaaataaaaggaagctcaacttttcgttgagctttttatcttgaataaagacaaaggagatcacacgtatgaatttggatttctcagcgacaatcccccaaattccttttatattggaaggccttgcggtcacattaaaaattgtgctcgtttcagcggtcatcggtcttgtattaggaatcgtgctcagcttatttaaaatcagcacgatcagtccgctgaaatggattgcggatttttatacttcgatattccgcggcacgccgcttgtgctgcagctgatgatcatctatttcggtatgccgcagcttctcggctttcagatcgatcaattttgggcggcggtcaccgcattatcgctcaattcagccgcttacgtctctgaaattatcagagcgggaatcaacgcaattgacaaaggacaaaaagaggctgccgtcgctctcggcgtgccgtacggaaaaatgatgaaagatctgctgctgccgcaggcgtttaaaaacatttctccggctattattaacgaattaatcaccttgacgaaagaatcggcaatcgtcacggtaatcggtctcggcgatattatgagacgggcctaccagtccggcgccgcaacatacaactatttagaacctcttattgtggcgggcttaatctattacgtgctcgttttgatcttagcattcatcggaaaaggcgtagaaaggaagctgaaagccaatgattaaggtcgacaacctgtcaaaatcattcgggaaacatgaagtactgaaaaacatttcaacacagatcgaagaaggggaagtcgtcgccgtcatcggcccttccggttccggcaaatcaacgtttctgcgctgcttaaatctgctggaaaccccgagcggcggaacgattgccattaaagaaaacgaaatcaccgcagctaaaacgaataaactgaaagtgcgggaaaatatcggcatggtatttcagcattttcatctgtttcctcataaaacggtgcttgaaaatatcacatacgcgccggtcagcgtgaagaaagagtctaaaaaggatgcggaggaaaaggcgtgcgctctccttgaaaaagtcgggctgcttgacaaacggaacgactatccgaaccgtttgtcaggcggacagaagcagcgggtcgccatcgcgcgggcgcttgccatgaatcctgacatcatgctgtttgatgaaccgacctcggctcttgacccggaaatggtcaaagaagttcttgaggtgatgaaagagctcgcgcagacgggcatgacaatggtgatcgtaacgcacgaaatgggatttgccaaagaagtcgcagaccgcgtattatttatggatgaagggacgatcgtggaagacggtcagccggaagaattttttctttctccgaagtcaaaaagagcacaggactttttagaaaaaatattataaaatataactgtaagaaaagaagaagaatgctcttcttcttttttttgagaaagaaacaaacagaatggagcaagcaatgtttaaaatcggttaccggacactaaagaccgcacttggaacggcgctggccatttatttagcccagctgttgcatctgcaaaacttcgcatccgcaggaatcatcaccatattgtgcatccagattacacaaaagcggtcgcttcaggcctcgtgggcccgatttgccgcctgtttattggcgatcgtcttttcatatgtctttttcggactgatcggctattatccgtttgcgatcggaatattgctggtgctgttcattccgactacagtcgttttaaaaataaatgaagggatcgtcaccagctcagtaatcattcttcatttatatatgtccggcggcattacgatggcgtttatctggaatgagttccagctgatcaccgtaggtatcggcgtcgcgctgttaatgaatctgtatatgccgagcctcgacagaaaactcgcagcgtacaggaaaaaaatcgaggacaacttttccgtcatcttcgccgaaatcgaacggtatttgttaactggtgagcaagattggacagggaaggaaataccggagacgcatcagatgattcaagaggcgaaaaacctcgcctatcgggacgtgcagaatcatattttgcgccatgaaaatctctactatcattattttaagatgaggcagaaacaatttgaaatcattgaacggctgctgccgaagattacctctatttcaataacggtggagcagggaaaaataatcgcccatttcatccatgaattaagggaagccattcatcccggcaataccgctcataaatttttaaaaagacttgcagaaatgagaacggaatttgaagaaatgccgctcccggcaacgcgtgaggagtttgaagcgcgggcggctttgttccacctcctcggtgagatggaacaatatctcgtgattaaaagttatttcaaaggcatcaagctgtaaaaaacatatggatcaatcgcatgagtcctcctttcattggtcattctaatgaaaaaaggaggggagcccatgcgattttttttattgtcagccgtcctgctgctgtctccgctttggccgcttggcgcgaaccctttgccgggtgacccttatattatcgtcaataaagccacaaatgcgcttgctgttgtaaaggataaccgaatagaaggcatttatcaggtggcgacgggaaaaacggatgatttgacgcctgaaggagaatttacggtaacggtcaaagccgtcaatccgtattaccggaagaaaaatgtagagggaggcgcgccggaaaacccgctcggcgtccgctggatcggttttgatgcgaaaggcaccgacggcagaatatacggcattcacggaacaaacagagaagagctgatcggggggtttgtatcaaacggctgcatccgtatgaaaaaccgggatgtcatccgtattttccggattatccctcccggaacgaaagtattgattacaaaagaaaaccgctcattcgaggacattgcaatagagcggaaagccctcataaaaaagcaggaaacccccttgcaatgaggcgcctgcttttttactgcaaatacatcataatgcctgagaggagggttgaaagtataaatacgcccaaaatgacgatgacggcgcttttcataaatttttgagacattgtttcactccttaagattactgtctaccattttaacgtgttttgcttatatgaacaagccatatcctatgggggaaagcaggtggccgcgctatgaaaaaacttgatcatgtcggcattgccgtcagctctattgaagccgcgagaggattttacgaacggatgctcgggcttacgtatatgggagacgagctggtaaacggccaaaatgtgagagttgcttttttagaagcgggaggcacaaagcttgagctgattgagccgctgtcggacgcgtctcccgtcagctcttttttacagaaaagaggcgaagggctgcatcatttggcattccgctgcgccgatatgaaggaaacgatcaaggagcttgaatcatgccgcatgaccttgcttcatcatgaaccgcaaaacggagcgggcgggaagaagatcgcatttctctctccaaaagaggcgaacggcgtcctgattgagctttgtgaaacaattgaaaaaggagaaactcaagatgaacatgagtgatcatatcagacacttaaacgaaagacgttcctttttaacaaacggcggcggagcggaaaaaaataaaaaacagcacaaaaaaggcaagctgacggcaagagaaagaattgactatctattggacgaagacagtttttcagagctgcagccgtttgccaaaagccgcacgcccgggtgccagaatgctccgggagacggcgttgttaccggatacggcacaattgacggacggcccgtgtatttgtttgcccatgactttaccgtactcggcgggacgctcggcgagacgcatgcggaaaaaatcgcggcggtaatggatctggcggcgaaaaacaaaaacccgatcatcgggctgaacgactcaggtggtgcgagaattcaagagggtgtggtatcattaaatggatacggtcatatctttaggcgcaacgtcctttactcgggagtgattccgcaaatttctgtcattcttgggccgtgtgccggcggtgctgtttattcacccgctttgacggattttgtgattatggcggaacatacgtcgcacatgtttattacaggtccgaaagtcattgaacaggtgacgggtgaacagattgacgcggaaagtttaggcggtgcgggaatacataatgtgataagcggaaatgcccactattccgcacgaacggaaaaagaggcactttcggctgtgaaaaccctgctttcttatctcccgcacggcggacagacggcactacccgttaaaaaggaagacgccagaccgttattaaacaccctcgttcccgcggacagttcgaaaccttacgatgtgttacaggtaataaaagagctggcggatgacggaacgttttttgacattcagccgtattttgccaaaaacattgctgtcggttttctgaaactcggacggcgtacagtcggtgttgtcgcaaaccagccgaaacacttggcggggagcctcacgattgatgccgctgacaaagcgtcgagattcatccgtttttgcgacgcgtttcatattccgctattgacgatcgctgatgttccgggatttcttccgggccttcagcaggaacatgcgggaatcatccgtcacggagcaaaattgctgtatgcttttgccgaagcggcggtgccgaaagtgacgctcatcatcagaaaagcttacggaggcgcttatgtcgccatgaattcgaaagggctcggagcagatcttgtattcgcctggcccaatgcggaaatcgccgtgatgggagcggaaggcgcggcgtcgattttatacagcagagacatacaggcttctggggacccggagaaaacgaagcgcgaaaaaaaagccatatacgaaaaggaaaacgccggtccgtataaagcggctgcctgcggtatggtggatgatatcatccggccggaagactcgaggaaaaaattgattcaggcatttgacatgcttgcgcataaggaagaggaaagaccgaaaaaaaagcacggtaatataccgctttaaacggagggaactgaaaatggtaaacgaaaaacgtctgcttgaagaatttcttgaactcgttcaaattgattcagagacaaaacatgaagcggaaatcagcaaggtgctcaaacaaaaattcactgatttaggattgagcgtaaaagaagatgatacaaaagaagtgacggggcatggagccggcaacttaatctgtacgttaaagggcacaaaagatgcggatacgatttattttacatcccacatggacacggttgttccgggcaaaggcgttaagccgattgtggaagacggctatgtaaaatccgacggcacgacgattctcggcgctgatgataagacgggccttgccgcaatgtttgaagccattaaagtgctgaaagaacaaaacatcgagcacggcaccattgaattcattatcacggccggagaagaatcgggattagtcggggcaaaagcaatggatcgttcagacattaccgcgaaatacggttttgcgcttgattcagacggaaaagtcggcaacattattgtagccgcgccgacacaagcgaaagtgagagcaaccattttcgggaaaacggctcatgcgggtgtagaaccggaaaaaggcatctccgcgattacaatcgcatcaaaagcaatctctaaaatgccgctcggccgtattgataaagaaacaacggctaatatcggccgtttcgaaggcggcacgcaaaccaatatcgtctgcgaccaggttgatattctggctgaagcgcgttcattagtgcctgaaaaaatggaagcgcaagtgcagaaaatgaaagaagctttcgaatctgctgcagctgagatgggaggccgcgcggaagtggacatcgcggtcatgtatccgggtttcaaatatcaggacggcgatcaggttgtggaagtcgcgaaaaaagcggcggcaaaaatcggccgtccgagcgaacttcagacaagcggcggcggaagtgacgcaaacgtcattgccggccacggcattccgacagtcaacctgtcagtaggctatgaacaaatccatacgaaaaatgaaaaaatgccgattgaagagctcgtcaaaacggcagaaatggtcgttgccattatcgaaacagcggccaactaaaaacgaagcacccagttgattgggtgcttttttcattcttcatgatattaggcttaaagctttgcagatacaagaaaaaaccctgccggataggttccggcagggtttcagtattatgatttggcgggctccgcctgagccgcagcctgtttctttttatgatgcgtctgctgtaaaagtacgttctgcactgtcaaaaacagtccgcttgtaaaccagtaaagcggcagcgcagccggtacgttaagcgaaaaaacggtcatcatgacagggaaaataaagaccatgatttttgctgactgcatcgcggccggattttgagcagccggtgaatatttctcgtttaatttttgggaaatataagcctgtaagaaatacatggcccccgcgcacagtgatacaagaatatcagaatgccctaagctgaaccacagaaatgagtgtgaagcaatttccggcgttgagcggatggcgtaataaaaaccgatcaaaatcgggaattgcaccagcatcggaagacatcccattgccatcggattcagattgtgctcacggtaaagcttcatcatttccatttgcagttctttttgtttttccgcatctttcgtttgtttcattttagcctgaatgctgtcgacctgcggtttgatcacagccattttttcctggaacacccgctgtttcttaaattggttcacaaacaaaggcaatacaacgatccggacgataatcgtcaccagaataatcgacagtccgtactcaccgtggaacaggcccgccaccccttttaaaagtgccgaaaacggctcgatcaggtaatcgtggaaaaaaccgatattcccgaggcctcccgtctgagtctgagatgtcgccgcaaaagccgagcggcctgtgcacagtacgataaaaaataatcccaatacgatccacttttgatatgttttagacaattatgtttcctcctttatatcttcacttgccgttataaaaggaggaagctgacatcttcatcatcattcgccggtgaattcatgcggatgactttacgtatccaagttgtaatgcgatgatatataataataagaaagtctgttcggttcagctgaacgactgcttgatgttcatctattcgtttcgttctccaatgctcgcctgcgcggcgctcacgcaaaagaaaagcgatgccgatcgcggtcagagcgggaagaataattgtgaaaaaatcgactaaaaataaaaagtcattcattgactcaagaatcattttatcacatccattcagctcttattttactacatatatataaggttgtctatgaaaggaaaggaggcgccgggagtggccggaaaagggagaattatatttcatatcgatatgaacagtttttatgcctccgtagaaatggcgtatgatccgtctttaagaggaaaacctatcgccgttgccggaaacgtgaaggaacggaaaggaatcatcgtcacctgcagctacgaagcgagagcgcggggcgtaaagaccaccatgccggtgtggcgggcaaaacgcctctgtccggaactcatcgtcgtgcctccgaattttgaccgctatcggagttcgtcaaaagaaatgttcagcattctgagggagtatacggatttagtcgagcctgtttctattgatgaaggatacatggatattacggacacaccgcacagacacagggcgtatgagacagccgcagacattcaggcgagactgcaaaaagagcttttgctcccgtcaagcatcggcatcgccccgaataaatttctcgctaaaatggcgtctgacatgaaaaaaccgctcggcatcaccattttaagaaaaagagagctgccggacgtcttatggcctcttccgatagaagagatgcacggtataggaacgaaaactgcggaaaaaataaaaacgctcggcatcaaaacgatcggtgatttggcaaaaggagatgaacatgcgctgaaaacgcttctcggcataaacggcccgaggctgaaggataaagcgaacggcatccatcctgcagaagtcaatcccgagcggatttatgaatttaaaagcgtcggcaactcatccaccctgtcgcatgattcggctgactgggatgaattaacgggcgtgtttgaccggcttgcgctgtctgtgagcgaacggctccagcgtaaggaggtcatggcctgccggctgttcatcatgattcggtatgcggattggaaaacggtcacaagaagcatgaccctcagcaatccggctgatcagaaaaaagacatcatggaagcggcgatggaactgtttgacaagcactggaaccaaaacccggtaaggcttctcggcatcaccgggacggaactggttgaaaaacagcaggcgtataaacagcttgatctgttttcattcaaggaggacgcaaaggatgagccgatttttcagatgatgaacgagctgaatgaaaagtacggccaaaacctgatcagaaaaggcgccgttataaaaaaagaagaaagcaaaacaaggggcacgagctttaacagagacttttttcaggatgaaaagaaaaggtgaataacttgaaaaaaggggttatgtatgataatttctttagtataaatatcattttattttaatttaaattttaaaatggttaaacgtttgaagaagggacgttagaatatgtcaaaacaacaaatcggagttatcggtcttgcggtaatgggtaaaaatctggctcttaacatcgaaagccggggattttctgtgtctgtatacaacagatcaagcagcaaaacggaagagtttttagaagaggcaaaaggtaaaaatgttgtcggtacatacagcattgaggagtttgtccagtctcttgaaacaccccgtaaaattttattaatggttaaagcgggaactgcaacggatgcgacgattcaatctcttcttcctcatctggaaaaagacgatattttgattgacggcggaaatacatactataaagatacacagcgccggaacaaagagcttgccgaaagcggcattcactttatcggaacgggtgtatcaggcggtgaagagggagcgctgaaagggccttctattatgccgggcggccaaaaggaagcgcacgaactcgtaaaaccgattttagaagccatttctgctaaagtggacggggaagcttgtacgacatacatcggcccggacggagcgggacactatgtgaaaatggtgcacaacggtatcgaatacggtgatatgcagctgatctctgagtcatatttcattttgaaacaggtgctcggattgtctgccgaagagcttcacgaagtattcgctgagtggaacaaaggagagcttgacagctatctgatcgaaatcacggctgatattttcactaaaaaagatgaagaaacgggcaaaccgctagttgacgtcatccttgataaagcaggccaaaaaggaacgggtaaatggacaagccaaagcgctcttgacttaggcgtgccgcttccgattatcactgaatctgtttttgcgcgtttcatttccgcaatgaaagaagagcgtgtgaaagcaagcggccttctgtccggaccagacgttaagccggtcactgaaaataaagaagagctgattgaagcggtcagaaaagcgctcttcatgagtaaaatctgttcttacgcacaaggcttcgctcaaatgaaagccgcgtctgaagaatataactgggatctgaaatacggtgaaatcgcgatgatcttccgcggcggctgtatcatccgcgcggcgttcctgcaaaagatcaaagacgcatatgaccgtgaaccggagcttgacaacctgctgttagacagctacttcaaaaacattgcagaaagctaccaaggcgctcttcgccaagtgatttcacttgccgtagcccaaggcgtgccggtaccttcgttctcaagcgcacttgcgtattacgacagctaccgtacggcagtgcttcctgcaaacttgattcaagcgcagcgtgattacttcggcgcgcatacgtatgaacgcacagataaagaaggcattttccatactgaatggatgaagtaatgaagaagcccccgcattgattgcgggggcttttctgatattaaaaaccgcgggccgtcatgaacggcgccgcggtttttaaattttttcttatatattccaccagtggagaccgtctttttcaagaagatcgtccgaagctttcggtcccattgaccctgcttcataattcggagaaagggttttgtcggctgcccacgtttcggaaatcgcatcgacgaaattccaggaaagcgccacttcgtcccaatgggcaaagtttgtcgcatcaccgagcagacagtcatggattaatttttcataggcttccggtgtgttcatttcatcactgcagttgctgcagtagtccagcttaatcggctgagcatgagcggctccgcctaattttttagcgttcagatatagtgtgatgccttcatccggctgaatatggatgacaagcaggttcggatttacattcgtttcattgccgtaataaaggttcatcggaatgtctttaaattgaacgacgattttcgttgatttttctttcatccgtttccctgttcggatataaaacggaacgccggcccagcggaagttatcgattaacagctttccggacacgaatgtttccgtattggaatccggtgctacattatgctcatctgtatagcttggtacagagtttccgtcaatcgttcccgcttggtattgtccgcggacgaagtagtcactcacttcgtttggagcgacagggcggagagctctcagcaccttcactttttcgctgcggatttcttccgtgttcagtttaatcggcggttccatcgccaagagagcgaccatttgcaaaatatggttttggaccatatcacggagtgcgcctgatttttcataatatctcgcgcggtcttcaacgccgagatcctcgcttgacgtaatctggatgtttgagatgtagcggttattccacagcggctcaaacagcgcattcgcaaaccggatgacttcgatattttgaaccatttgtttgcctaaataatggtcgatccggtaaatttgatcttccgtgaaagcttcgcgtatttctttgttaagctctttcgcactcggcaggtcatggccgaacggtttttcaatgacgagacgggaccagccatttgtcgctgtgacaccttcgtttttaagtgattttgcgatcgtgccgaaaaactcaggagccatcgccaagtaaaacattctgttgttcgggatttcatatgtatgttcaagctgatcaagcaggacattcagctcctgataggaacccggattcgttacatcaaacggatggtaataaaaatgagatgtgaaatcgtctatgtctttttgcccggcagaagaaacagacgttttaaccgtttcccggaggtcctcgtttgaccaaggtcttcttccaacacctacaactgcaaactcttcaccaatttgaccatttttatataaacggtgaatggatgggtaaagttttcgttttgccaaatcccctgtggcaccaaatattacaattactgcttttggtttgtcgtttgttttcacttagagtacctcactttatctgaagcatggtttaaaaccccgcatatttccttcattttaaatctaaaattcattgaaagcaaacatttcagcctgttttttgcggtttgcggaaaaaaattaatcaggccggagaaggcccgggtgaattcacattttcagtctgatcctgtatccttagtagtacaaagatctaggaggaagcattgtggaattattatttttagggacgggggccggcatgccggcaaagacgagaaacgtaacgtccgtcgcgctgaagcttcttgaagaaaggcgttccgtatggctgtttgattgcggagaagccactcagcatcagatattacatacaacaatcaaaccgaggaaaatagaaaagattttcatcacccaccttcacggcgaccatgtttacggtcttccgggtctgttggggagccgttcatttcagggcggtgaagaagagctgacgatttacgggccaaaaggcattaaagcctttatcgaaacaagcctgaacgtgacggcgactcatctgacgtatcctcttaccgtacatgaaatcgaagaggggacggtttttgaagatgagcacttcattgttaccgcagcatccgtcattcacggtgtggaagcgttcggctaccgggttcaggaaaaggatattcccggcgcattgcaggccggcagattgaaagaaatgaatatcccgcccggacccgtctatcagaaactcaaaaaaggcgaaacggtcacacttgacgatggcagaatcattaatgggcgggattttctggaatccccgaaaaaagggagaatcgtcgctttttccggggatacgagggcatcagagcgggtaacggagcttgcgcgcaatgcggatgtgcttgttcatgaagcgacgtttgccaaggaagatgcaaagctcgcacataattattatcacgcgacgacagaacaggctgcgcaaacggcaaaaaaagcaggcgccaaacagctgatcttaactcatatcagcgcaaggtatcagggtgaatcgccgatagagcgtctcgaacatgaggcgaaagcggtatttgaaaacagtaagatcgcatttgacttcatggaggtcactgtggagcggtcttaaaaaatagacgcttgacatttttttctgatgatatataataaaacgtaataattacgatttaaaaaaggggtgaaaatgatgcgtgtgaatgttacattggcctgtacagagacaggggacagaaattatatcacgacgaagaacaaacggacgaatccggaccggttagaaatgaaaaagtattcaccccggttgaaaaagtatactttgcatcgtgagaccaaatagatcacgataacaaaagccattgtgccgttgcacaatggcttttgttttcatcagtttaccgcctgataggcaggagcattcatttgctggcgcaccgcgcaccaaacatcataaatggcaaggtggacgatgtgcggttcatcgtgatgaatggcatgagaactgtttttggcctgaatccatccgctttgataagagacatcaagcatgcttctgtgcagtttcacccattgttcatgagcgtgctttaagcgctcatcccgctctcccgatgataaaatcaacagcggcatatcgccgaaatgaatctgctgatgctggatctgcctaaggctcgttaaaaattctgcgtgtgatccttccaatttgaactgtttcaaataggcggccttcatttcttcaggaagaagcggaagcactttcgtctcctgatcctcagaaaccggatcaagcagcaccatcccgagaatatcccggcggttccggctcgcccaaagtctgctgataatcgtgccgtatgaatgcgagacgacaaggtaaggaggcttgacgccggccttcagaagaagagcgcttaattcctgtaccatatggtccgccgttctcttgtttcggcttcgtccgcttttgccgattccggctctgtcatatgtgaaaaccccaaattcttcatctatgtcagcgagtaatgatgtccatgtttcagaagaagtgccgtagccggcttcaaagacgatcgtcacttcgccggcgcctttacggtgtttcgtataaaacggacacccgtcaatcagatatgtcctttccatccatgctgctttcattggagtcatctcctctaattggttctatagggaagacggagaagcttcggcaatcgtttctcgaaaaataaaaaaagagacagccgggatcgaaaaactccggctgtcacttcatcaccatgctctgtcgtattggaccggtgacggtatttcagtattcagctgcttcgctgcactccttgcaaagtgcggatcgcggagaagttctctcgcgacaaaaataaggtcagcgcggttgttgtgcagaatttcttcggccattgttcccgtcgttatcaaaccgacggcgcctgttgcaatttcggcctgttcacggattttctccgcgaagctcacttggtagccggggaagacgttaatatcagcttgaacgagtgcgcctgagctgcaatcaatgaggtcgactccctgttctttcatccacttcgcaaaaccgatatgatccgcaatgtccagccctttgtctgtataatccgatgcagaaatacggacaaataacgggccgtcccagacttccttgacggcttcaatggtctcgcctaagaagcggtagcgattttcatgtgagcctccgtattcgtctgtacggtgattggacagaggggacaaaaattcgtgcattaagtagccgtgtgcggcatgaagttcaatgatgtcaaagccggcttctttcgcgcgcgccgctgcctgtttgaattcctgaatggtttctttaatttgttctgtcgtcatttcagccggtgttttggactgctcatcgaacggaatggctgacggagcgtaaatgtctccctcaagctcagctttacgtccggcgtgcgcaagctgaatgccgattttagatccttgcgctttcacttgttccgtcagtttggcaaaaccttcgatatgatcatcgctccagatgcccaaatcctgatcggaaatgcgcccctgaggattaacggctgtcgcttccacgataatcaggccgacctgtccgattgcacgcgatatgtagtgcgccatatgaaaaggctgcagttttccgtccttctcatgtgaggaatacatacacatcggtgccataacaatacggtttttgatcgttacatctttaacggtccatggtgtgaataattttctcgccatttatttcgcctcccggaatgtttttcgacattgattataacaactcatgatcattcagtcatataaactgctcacaactgaacagatcgttcttattgttctggacgggcatttttttatacacagcgtggccgtatcttcataacaggcatttacagccgatcatatagcaaatatagatgagaaacgcaccgatgactgcgtggcctcctttgatccagtttgtcaggatgaaaatactgctgatgaagatcactgcgccgaaggcaccgaatattccgtttttttgagcggctctgaaatcgtcggggctcatatttttcagctgcaagtgaatattcagtaacgacatgatcggcagcaatgtgataacgcctgataaaaataagtatttcgacttgcttaaatacgcggcggccaccataacggtgccgccgataaaaaattgaatgagaaaactcatgctgaaacgctcaccttctgtttgttatcaagtataatgatggagacattgccattttatttttgattgatgtataagtaaactaaatataactaatgcattggataataaagaatgatatctgggagatgaagccgattggatttaaagaagcatttagcctttattaaaacggtagaaagcggcagcctgacccaagccgctgccatattgaattacacacagccgaacatcagccaaatgatcagtaaattagaggaagagtacggttttccgcttttgatcagacagcggcatggagtgaggcccaccgcaaatggcttgaaagtgttacatattatgaaggaaattcaaaaaaactatgaaaaactgtctcaaaccgttgataatattaatgggttagaaagaggggaagtccggctcggcactgttacgagcgtggcggtaaaatggctgccgaaaattttgagggaatttaatgagctgtatccttctattaaggtgcatttatttgatggaaattctactgagctggaacaatggctgaaagatgaccggattgatgcggcgattgggacatcccacagcgagaagtggcatttttacccgttggccgaggacccgattgtagcggtgatgagcccgcagcatgaattggcgcaatatgaaacggttccgttacatgtcatggagtccgtcaaatgtatcgtgccttatccggagacacattttgatgtgctgaaagtgttaaaggaagaaaagatcactccgcgggttgcttatcaaatcagaggggatgaagcgattattgcaatggtgcggaataatctggggatcagcatcttgccgcagcttttggtgaatgatggtgatgtgctcatcaaacggttcgaccggtatgtctccaggcagctcggcattttgacagctcgtgcaaaggagacgcagacaccttctgtccagaaactgattcaatgcatacaagaatgggttgcggtccatcaggcttctgcctgaagaagcctgatatgcgtttaagccggttcaggataatagaccagcaataaatatgtcatcggttccgaggaatgaaaataactgtgcggcatcgcccgaagtcagcacatgcttttcgtcatgaagctcaaccgtcaattcaccgctcttgattaaaatgattcccctaaatgtgattttgtctcataggcgcagcccggcttcaggtcaactatgccttgaaaacaaaaatttgaccgtgacggtggtgagcggggttattttgatgtcgggctttcgtctgtttatataaaaagggcatcaacggcacatgctgttgatgctttttttgaaatgctagggtttggagagcacttcaattccgacgttgaccattttgtccagccccataaaagacaggcagattttggcgcgtctttttcttttatcgatttttttaataatgccttccattcctttaagaggccctgaggcaacggttacttttgaattttcaatatagacttttgaataatctacagtgtctccttctccgatcagcctgataatagggaggatttcttcatccttaattgtcgtgaaataggttttgcgctctttggaataatatgctccgttattcacgattctgcatgaaatggggagttctttgattttatgaaatgtccgctctgtcatctttgttttaaacagaacatatcccggaaacatctttttgagtgcctcgtatttaattccggcttttcgttctgtgacttttttcttgggtatgattgagtagagagcctgctcatcaaactgcagacgcagaaatttttgaactgcttcttcttttcccgactctacaaaaagtgcgtaccatttcatgactggatcctccttagaataataagaaattattatacaaagaaagtatttaatggatagtatttaaagtgattaaaaatttttctaattcgtcttttttttacataatatatgaaaatgaaaaataagtatagacccaattgacagagaggcgatgaattttctttgacatgaaaagggttcagggaattatctgacatttatcccgaaacaattatgccgactgtccaccgaatataaaactgtggaataaatgtcagaaaataacgaaataaagccttgacattattatctataaattgatattattctctttaaatagcaactatttgttaaatttattaaattaaagtaaagcacctattaaatttcaatcgctgtttcggcacgttgaagaggaaatagggattataaaaatgattgcagtgtatatatctacatatacatgataagggagaagtgtgccgtcatggctgttttcgggcatattggcactgcagcttgtcatgcgaaacattcagtaaacaagcaagatgttttaatataaattatgttagaaaaggaaaacacaatgcgtttgcgatttttaaacctgtgctgaatcgcaaacgcgtttgtgtttttatttttatggcggtgtttacaccagtcaatatatgaaataagagacgtttttgtatggagaaccacatgtgatgtacaaaattggcgatggggaaaggatgaggataagatgcttacgtttgtgttcccggggcagggttctcaatttaaaggaatgggagccgggctgtttgatgaatttcaagatctgacacgtcaggctgatgacatattaggctactctatagaagaattgtgcctggaggatccgaatcatcagctggggaaaacgcaatttacccagccggcgttatatacggtaagtgcactcagttatttaaagaagattaaagagtccggcagagagcccgattacgccgcagggcacagtttaggagaatataatgcgttatttgcggccggctgctttgattttaagaccggtttgcagcttgtgaaaaaaagaggggagctcatgagcaaggcagctcccggaggcatggcggcggttttggggtttacggctgaacaagtaaaagaggttctatccgattatcatctgaccggcattgatatcgctaaccacaattcaccttcgcaaattgtgatcgccggaacgaaacaagacattcaaaaagcgggccccgcctttgaaaaagccggcgtgagaatgtatcttcctttaaatgtgagcggcgccttccattcccgctatatgaaagatgctgaaaaagagttcgcggattatttagaagaaacggcgtttttgcctcttcgttttccggtgatctcaaatcttcatgccgcaccttataagaatgatgaaatcaaaacaaatctgactttgcaaatgaccaatcaggtaaagtggacggacacgatacgccgtctgataggacttgaaaataatgaaattgcagaagtcgggcccggggaagtgctgacaaaactgacgaggcagattaaaaaagatgccgtcccattacctatgccgaaagaagagtctgatactgctgatgttaaagcatcggcagctgattcccaaaaaacggcgggaatgagattagggaacgaagattttaaaaaagattataacatccaatatgcttacatgacgggctccatgtacaggggaattgcttcggaacagatggtcattaaagcggcaaaagcgggaatgctgggctttttcggaacgggcggattgagtatcgaacggatcggacaggccatcggaaccatccggtctgcactgcggcaaggggaaacattcggaatgaatcttcttcatcatatgatgtcacctgacaaggaagtcagaatgatagatttatatttaaaaaacggcattcaccttattgaagcatcggcatttatgggcataaccccggctctcgtgatatacagggcaaagggattaagcaggaatcatgacggatcggtgtcagtccaaaacagaatcatcgcgaaagtatcccggcctgaagtcgctgaggcctttctgaatccggctccggctcatgtgctggaaagacttgtgtctgacaatcggctgacagccggggaagcggcgcttgcaaaagaaattccgatggctgatgacatttgcgttgaagcggattcaggagggcataccgaccaagggattccgtatacattaatgcctgccatgatcagactcagagaccgcatgatggagaagcacggttatgcgaaaaaagtaagaatcggcgcagcgggcggcatcggcactccggaagcggctgctgccgcgtttctgctcggcgccgaatttatcggaaccggttctattaatcaatgcacggtcgaagccgggacaagtgattcagtgaaagatctgcttcaggaagcgaacgtgcaggatacgtcatacgctcccgcgggagatatgtttgaagcgggagcaagggtgcaggtgctgaaaaaaggcctgtttttcccggcaagagccaataaactctttgacttgtacagacaatacaattctttagatgaaatagatgaaaaaacgaaaacattaattgaagataagtatttccagcgcagttttgaggaagtgtatgagcagttgaaacgtgataaatctcctgaacagatcgccaaagccgaacagaatccgaaacacaaaatggcgatggtatttaaatggtatttttcccatacgacgaggctcgctctggaaggaaaaagcgaaagtaaaatagattaccaaattcattgcggccctgcgctcggcgcgtttaatcaatgggtgaaaggaacccctcttgaaaattggagaaacaggcatgtcgacttgatcggcaaacagctcatggaagaaacagccggccttcttgcgcaaaggctggtatcgattacaggctgagtatgaccagacattacattttttctgcggaggactaccatgctgattgaaaatcatgaattaacgatgagccatgtcggattagggaatttgaatgagtacgcgctgctgctgttattcggcaatgcacacagtcaccatttaacggacggaacgggattccggcctgatcagatggccgatcaccaagggctgattttgtatccggcttattttatgacacatctcaaagttccttcagataagcctcttgatcagtaccgattatgggacgaggtttccgtcggagtcgatatctcccggtttggagaaaccatattagaatctgattatttgttcgggccgaaaggagcggtcagctctgataaaagcgagtgggaccggggacggtttccttctatgaaagccaatagtttaattgtcgttgacgtcacacaaacagaaggttcgacgcgcaaagtctcagcgccgaaggctgaatgtattgcggaactttctaagctagccaagccgccttacgcgctgatgcggtcaaagaaagtcagaacggacgctttcggtatgaagccgggaaacctcaaaacagcggaccccgtttcatatcgggttcctgttgatcaggatgctgcgccggggcatgccatggtgtttgcgaaattcagcaagataatggatgcggcggaatttgaatggatgacgcgccggtcgaagccgggttttccggtttcaatcgcgcggcatttatttttgcttgaaagagagacgtattattacggaaattgttttgcagatgaagagcttgatatttatatgacgggacacattgaagaatgcgatcccgactttcacggtgagtccctcggtatgatctcagtggcgaaaatcagctatcagattgaagtctatatgaaaaggaatcatacattgctggccatttccaaggtggataagctgctggcggtgccgacctcttcacaagatcatattccggattataaacgggtcatcagaagtttataaaatgaagaatggagctgaaagcaaatggaacaaaccaaggaaatgaagcagatcatcgctcaaattattcaggatattcaagaacagcagtcatatcgggccgtcgaagcgggagatgatgtgagagtcatagaggatctgggcttctcatcactggatatcgctcaattagtcgcacagatggagatggaaaccggagtggatcctttttcccaaggagaaacgatttccagcattacaaccgtcggcagcatttgtgatatttatcaaaaatacatggacagtgctcaatcatgaaaacagaaagcaggggagatatcagctgggtgactgataagcttagggaaacgcaggacagtgagtttctcatttttaaagggcagacttttacgtatgatgatttgctgacacgaatcagcttttttcagaaagaacttgaacaaaacggaatacgtgaaggagaatgtgtggcgcttatcggggattattccccgaacgccatttttttgctgatggcgcttttgttaaaccgaaatatcgttgtccctctcagcaatgaatcaagggaaaagcatctcgatatgtttgaagacgcgaaagtgaatcaaatcattgaaataaatgaaaatgacagctggacgcttcgtgaaggttctgaaagcgcctctcaccctctgcttgatgacctgcgcgagaaaggggagtcaggcattattattttcacatcgggaacctccggcaaaagcaaagcatccgtgttaagcgccggccggctgcttgaaaaatacaaaacggcgaagagaaaaccgctgcgtacgctcatttttctgaaattggatcatataggcggcattaatacgctgtttgcgattctgtttaacgggggaacgatcgtcacatcagacagcagaacgccggagtccgtttatcaggcggtcgacaaatatgctgtccaagtgctccccgccacccctacttttttaaacatgctgctgatgtccaaggcggatgccggctataacctgtcttcactccagctgatcacttacggcacagaaccgatgccccaatcaacgctgcgcggcattcaccggctgtttccggatgtacggctgaaacaaacatacggattaactgaactgggtatattctcaacgaaatcaaaagacagccaatccacttggatgaaagtaggcggtgccggaacagagaccaaaattaccggaggcacgctttgggtccgttctgagtcggcgatgctcggctatttaaacgcaccctcacctttcgatgaagacggctggtacgacaccggtgaccaggtggaaacagacggcgaatatataagaattctcggaagaaagagtgaaatcattaatgtgggcggagagaaagtgtttccggcagaggtggaaagcgtctttctggagatacctaatgtccgggatgttctcataacgggccgaaaaaatccgattacaggcgagattgtcgcggcagaggccgtacttgaaaaagaggaagatatcaaatctttcagaaagcgggccgtagctcattgcagacagaagctgcagccatatcagataccgcagatcatctctgttacagatcggaaactgtctaatgaccgatttaaaaaaataagaaacgtataaaacaggaggcaaatatgaataacggaaaagtagcggtcgtcagcggaggtagccgggggctcggaaaagcgattgtacaggcgcttttggatgagaattacaaagtagccgctttcagccgcagtgaatctgattttattaacacattgagagagagtgaaaagtaccgtgaccgcttttattgggaagcggcggatgcggcggatgatgccgccatgaaacagtttgttcttcaagtgtaccgcaagttttccagaatagacggcttggtcaataacgccggtttgaaccttgatcagctgctgcccctgaccaatgatgaagacattgaccgcatcctcaatctgaatatcggttcagtcatcaagctgacccgaaacgtttcccgggtcatgctgaaacaaaattccggatcaatcgttaacataagctccattatcggttcaagaggatttaaaggcacttcagtctacagcgcatccaaagcggctcttgacggcttgacgcgaagcctggccagggagctcgggtccaaaggaatccgtgtcaattcacttgcgcccggttttgtggacaccgatatgacgaaaaatatgccggaaaaacaaaaatcgcagattatcagaaggacgccgatggggcgtttaggcgaaacagacgatatgaccggactcgttcgttttctgctttctcctgaatcgtcctttatgaccggacagacaatggcaatagacggcggattaacttgttaaagcacagaaaaattcttttgtacaagggatggtatcctcatgaaatgtattaacgaatttttaagaacggtaatagcggaaaagctgggtgccgaggtgaccgaagcagaagataaaaccgctttttttactcttggcgtgacgtctctcatcagtgaagaaatcatgaccatattgcataaagaatttaccggcctttctgaaacgctgctgtttgaatatccgaacattgagaaattgagtgagtttttaagtgcgcagaaacgaaatcccgaaagcgttcttgaattcaaagaaacggagcctgatacgggaagccggcaggaagaagaagtgcttcctgtacaggcggctgaaaaggtgcctgaaccgggaacggacaggagttctgatattgcggttatcggaatgagcgggatgtttccgaaagcggaaaaccagcatgatttttgggacaatttaatggaaaataaagattgtgtctccgaaatccctgaggacagatgggacagctcttattactcggaagagaaaacggcaaaatacgcgtcatacagtaaatggggaggttttattgatcgtccggatcgatttgacccgctgtttttttctgtttccccgtgggaagctgatttaatggaccctcagcaaaaattgtatgtcacgtgctgctgggaagcgatggaggatgccggttacgggaacccggcggcgaggccgacggatcaaatcggtgtattcgccggagtgacctggaatgaatattcattaattgcacacgaagaaggtttcctcaaagatcagtataaaggccccggctccttatattggggcattccgaaccgggtttcttattttcttgatctccatgggccgagcatcgctgttgatacggcgtgttcttcatcgcttgtcgccgtccatcaggcttgtcaggccattatgtcgggcgactgtgaaatggcgcttgccggaggcgtcaacctcagcttacatccgcaaaaatacatgtttttaagccaatcgcattttctgtcttctgaaggaaaatgccgcagcttcggtgaaggcggagacggttacgtgcccggtgaaggcgcgggagccgttttgttaaaaccattgaaaaaagcgattgcggacaacgaccacatctacggtgtcattaaggggtccgccactaatcacggcggcaaaacgaccgggtatacggtgccgaatccggaagcgcaccgggacctgattttatccgctataaacagagccgcggtaagtccggcggatatcagctacattgaagctcacggtaccggcacggcactcggcgatccgattgagatacgcggtctgtctatggcatttgagaaacagaccgatgagaaaaatgactgcggaatcggctcggtgaaatccaatatcggacatttggaagcggctgcagggatcgccggtttaatcaaggtgcttttaagcatgaaacatgaaacgcttcccgccagtctgcacgccgaggaactgaaccgcaagatttctttttctgattcgccattttatgtcgtccgaaacaatcggccgtggccggctgaaggagataaaccgagaatcgccgcaatcagttcattcggcgcaggaggctctaatgcccatctgatcgtaggtgcttatcagccaaaacggcaagcggacgggaatactgagcaaaaaccgcatgccgtcgtactaagcgcacattccgaacagcagctgaaagaatatgccggaaaattgagctcctttcttgcccgattggaaaactcgccttctgccggcggatacagcctggaaaatatcgctgccaccctattgtcaggcagagagcctttctccttccggcttgctgtcattgcgtcatcccttcccgagctgaaacagcgattggacggctttgtgagcgggcacagcggcggcaggcatatttacttcggaaaagcgtcacccggacggccggacgtttcaggccaatccgtttcagatcctgaaaaatttgccgcgctgtgggtcaaaggccttcaaggtttcaaaaagccggagacgccgtatcagaaagttccgcttcctacgtatccgtttttaaaggaaacgtcctggctgaccgaccaaaaaaagcggtatacgaaaaagccccaatctgtcaaaaggcgtgaagcgctgcatccgctgcttgatgagaatgtttcatccgcccggaaagggacgtttcaaaagatattttccaaggatgaatatttctttaaagatcatttagtgaacgaaaaatatgtgctccccggagtctgtcatcttgaaatggcggcatacggcgcggcattgtggggagaacgcccggtcgtctctcttcaaaatgtgtggtatatggagccgattgtgacagggacagacccaagatccgtcatgatagagtttgaagcggaaaaagagcgtataagctatgtcattaaggaaaaaggagcggacggcactctcttttcgcaaggagaagtgatttgtaaagaaaatggagcgtcgtttgaggccccggtctttcagcttccggcgccatttacgcagagaacggagccgaaagacatctatcactcgttctctgaggcgggaatcgtgcaaaaggacagttttcaggtcatccgcgaattctcttatacagaaaggaaagcactggccaaattaacgctcccgtcacacttggaagcggattttaaacagtacatcctgcatccgtccttactggatggcgctgttcaaactgcaatggcgcatgtgctgcaatttcaaaaagagcctgcgcttatcgtaccgttttccttcggagaaatacagctgcttaaaccgttagcgaaaaccgtatttgtgcatgcggaggtaaaagcggcctccgttcaccaatttgatctgcatatttgtgatgagcgcggtgtgctgctggcggcagtgaaagattttatcataaaagaggtgcaggaaagcgccgggtttaaccaaaaagccggcgtcatgccgaagaaaagccgtgaaacggaattgcttatgacaccggtttggaacaccgtcaccattccggaaaccggcatgtctttcatgcgtgaagaaaaaataatcgtcatcgggggcgggccggattttcagcaggctttgaaagagatgtattccgatgtccgttttccggacatcacttctttggacagcgcggaacaaatagctgaaacactgaaagcgcaaggctcttttcaacacatgatatgggcggcgccggatcatccgattccatccgtttatgatgcggatacggccgacggacaggagcacggggtcatgcagcttttccggctggtaaaatcgcttctgcttctgaattttgacacggaacaactatcattgacaatctgcacgtttcaagcacagccgattcatgaacatgatgaggtcaatccgagtcatgcaagcatacacggattagcgggggcgctcgcaaaagaatacagcaattggagcatccggcttcttgatttggaatctcaaaggggagaccggcatcttcccgatatcttctctttaccggcggaccccgagggaaatccgtgggtctttcgtgcaggtcagtggcaccgccagcaattggccgtctgccagcctcatgcaggtgagccttcattataccggcacggcggggtttatgtgattatcggcggagcaggcggaataggagaagtatggactgaatatatgattcagacctatcaggcgaaaattgtctggatcgggagacggaaaaaagatacacagattgaaagaaagctgaaaagacttgcggctttaggtcccgcaccgcaatatttcagcgcggatgctgcggattatgattctctcaagcgggcgtatgacaccattgtgaaggaacatggaaaggtgcgcggaatcattcattccgccatcgtgttatcagaccggagttttgccaatatggaagaggaccagttccgcgcttcactttctgcaaaaactgatgtcagcttgcagattgcccgggtagctgaaggggaaccgctggatttcttgctgtttttctcttcgatgatgtcgtttcaaaaagcgccgggacagagcaattatgccgccgggtgcacgtttaaagacgcttttgctaagcggatctcacaaaaagcgccgtatgccgtaaaggttgtcaattggggcttttggggaagtgtcggcgttgtcgcttcagaacaataccggaaacggatggagcgggacggaatcgcttctattgaggcgcccgaagcgatgaaaacgctggaaaccctgctttcgggaccttatgaccagctggcgctgatcaaaacgacagatccggtttttatgaaagatgatctgaaagaacaagtaacggtttatccggaaaagattccttccgcactcggacaattagcggttaacatcacgcagaatgacgaagctgagcgggtaaaagcatcaaatgtcatgagctgcatgagagagatggaatccctcattgaaaaaatacttgtatcaaccctttatgagatgggcgcaaggcttgatgagactttgccgttatttcaatcggctgccggcataacggaacaatacagcagatggctgaaagagagctttgtcttcctgactgaattagcgcttgctccggaaaaaacggatctaggggaggtgtgggaggaatgggagcggaaaaaagagacttggctgcgccggaaagacatgagggcgcatgtcagattggcagaagagacattgcgtgtgcttccagacattttaaccggtaagcttccggcaacggaagtgatgttccctgactcctccttccgtcttgtggaaggcatttaccgcaataatatcatttctgattttttcaatgacaagcttgctgacacattgattgcagttttgcgggagcgtctggaaaaagacccgcaggcgaaaatccgcattttagaaatcggagccggaacgggcgggacgagcgccgcggtcatgagaaaattgaaaccgtatgaagcgcatattgccgaatattgtttcacagatatttctaaagtatttcttttacatgcagaagacatattcggtccggaatatccttatgtcacttataaaatattcaacgctgagcagccggtatcaacagaagcgccggacatcggcacgtatgacgcagtgatcgcgaccaatgtgcttcatgcgacaaaaaatatccgctctacgctgcgccatgcgaaagcaatgctgcaaaaaaacggccagctgtttataaatgagatcaacagccgcaccgtattcaaccatgtgacgttcggccttcttgaaggctggtggctgtatgaggatcatgatttacggattccgggctgtccgggggttgagccggccggctggtcggaagcgctttcacttgaagggttcgtccatcctctgtttccggctgaagccgcacacgacttaggccagcagattatagcggctgaaagtgacggaacggtcaggcttgccctcccgcaggcgtcagaagaaaaaccggagcgccgtccgtatgacgcagatggtctttcggatgatacattgcatttcagcttgagagaaaaaagcgttgaactgatgaagaaggtaatcggtgaagcgcttaaagtgccggcgcatcgtcttttatcccatgaacctttaaccgcatacggattggattccatactggtcgtcagactgaccaacgcgttaaaagacgtcttcggttctgtcagcagcactttgttttttgaatatcaaaccattgatgagcttgctgattactttctgtcttcccgtaaagaagcgctcgagcggcaattcgggaatggacgggctcattccgaaaacgccggacggatgcaggctcccgcagaaagcgccgcgccgattccaaacgtaagggaacggggcatcacatatctgacggaattaataggaaaaacgctaaagattccgagcaggagaatggatccgtcggtttccttaaccgcatacggtttggattctattctggtcgtcaggctcacaaatgcttttcgtaacgtgtttgaccaaatgaccagcaccctcttttttgaatatcagacgatagaagaaatcgcggattacctgcttctttctcagcggagagcatttatgaaagcgatgggtgtgcgtgaggagcagctgtctgatcacacagataacctgaatgtaattcctcaaaacgaggaagaaagcaggacaaacggagatccctatatccaggatatcgctgtcatcggtctgtcaggccggtatccgggcgccgatcacgttgatgagctgtgggaaaatgtaaaagccggcaggcattctattacagaagtgccgaaagatcgctgggactggaaaacgttttataacgaggaacgcggaaaatgggggtccatttattcaaaatggggcggtttcctcgatgacattgataaatttgatccgctgtttttccgtatatctcccgcggaagctgaaaggatggatccgcaggaaaggttgtttctgcagactgcttattcaagcattgaagatgcggggtacaccccggccacgctttgtgacagccggaaaatcggagtctttgtcggtgtgatgaacagcaattacccgacagttcccagcgactggtctatcgcaaacagagtatcgtttttgttcaattttcaagggccgagtatggctgtggatacagcctgttcttcttctttaacagctgtccatctcgctgcagaaagcctgcggagcggaatgagtgaaacagcgattgccggcggagtcaatcttatcgttgatccggctcactatgagcggctgtccgctttttcaatgctgtctcccggtgataaatgcaaatctttcggagacagggcggacggttttgttgacggtgaaggagtaggggcgattgtgttaaagccgcttgctcaagcggagaaagacggcgatcatatttacggcgttatcaaaggaagcatgctgaacgcagcaggcaggacaaacgcttatatggtgccgaatccgaaagcgcagtttgatctgatcgcagagacgttgaaacggacagacattcacccgagaacggtcagttacttggaagcccacggaacgggcactgcgctcggtgatccgattgaaatcgacgggttaacgaaagcttttcgcctgacaacagaagaccggcagttttgttccatcggttcaattaaatcaaatatcggacatttagaaagcgctgccgggattgcgggaatcaccaaactgcttctccaattgaaacataagaggattgccccttcattgcatgcggcggaattgaatccgaatattgagtttgagcacactccgtttttcgtacagcaaaaagaaacggaatggaaacgacctgtcttgaatatcacgggtgaaatgaaggaatatccgagaattgccggtatttcctcttttggagcaggaggggcaaacgcgcatatcatcattcaggaatatgtgccgtctgacagcctgaaaccaagggaaaacgcgtctgtttctccgcaaaaaccggctgttattattttatcagcgcgaaatgagcagcaattgacagagcgcgcccgccagcttctggatgatgtcataagaaaaaaacgttctgacggggatttggccaaaatcgcttacacgcttcaggcgggaagagaaccgatggctgagcggcttgcatttacggccgagtcgatagaagaactgaaaatgaagcttatgagtttctcaaacgatcatatcgaacatgctcatatctggcggggcaggacagccaaacatcattcattggcggcttcgctcacttctgatgaagatatggcgcttaccataaatgcctggctgaaaaaagggaaatacggaaagctgcttgacctttgggttaaaggacttgacgtcgattggtcagctctttatcagcgcaacccgggccgcatcagtctcccggcttatccttttgccaaagaccgatattgggtcacaaaagctgatgtgtcacttgacaaaacaggctcagcggaaagtgagaaagcagccagacttcacccgctgctccacgcgaatacatcgacctttaccgcccagcgctttacttctgttttttcagggcgtgaaccgttttttgccgatcacatcgtcaatggaaaaccggtgcttccgggcgcggctgctttagaaatggcccgggccgccgttacacttgccgctgagggcttgccgggcgggaaagcgggtgtccggctcaaacagatcgtttggctccgtccggtgacggcgctttctgaaggcgtgacgcttcatgtaaagcttcagccggaagaaaacggagacatcgcttttgaagcgtatgccgaaggagaagagccgcttgtctttttccagggaaaggccgtgctcgaagagacggagcgtgctccggtactcgatgtggaggcggttcaggcgcgctgcggcggccggcgcatgtcaaaggctgagtgctatgaagcattcgacagtctcggcatcacctacggaccgtctcatcaggcgcttgacgccgtctatgccggaagcggagaagtgctcgcgaagctcactcttccgccgtacgcccgcgaagaaaaggagccgttcatcctgcatccgagcatgctggacgccgccctccaggcttctatcggtctcgtgcactcagacggttccgcgtccggacggccgtttctgccgtttgccctccaagatatgcaggtgttttctgcgtgccgggagacgatgtgggcggtgctttcctcagcggacggcgcctatcatattgagctgtgtgatgaaaacggcgaggtatgtgtccgattgacggggctcaccgcccgttttctggaagaggaaacggagggaaaaccgctcttgcttcagccaaagtggcaggaatcaccgccgggtgaaggcggcggacaagcagagtctttcagatacgtgacgctgtatggcggaatgaacgctgaggacataaacggcgccgtatgtgcggctgacggggaaggtccgattgaagaccgttatgacgcctgcgcggcggagctgtcagcgatcgtcaagcgtcttatcaaagaaaaacagaagggaaaaacgctgatccagcttcttgtccccgacaggggggaagacaatgtattggcggggctggccgctttcctgaaaacggctcaccttgaacatccgaagctgtacggccaagtcatccaagccgatccggacgagccagcatcatcgcttcttgccaagctgaaagaaaaccggacgcaccctgaacaagcggaaatccgttatcaagccggcaaacgtctcgtcagaaactggcgtcacctgcctgcgcttcaaagcggcgccgttccgtggaaagacgaaggggtttacctcctcaccgggggagcgggcggcatcgggctgattttcgctgaagaaatagcctcccgcgtcaaaaacgccgtcctcatattaacgggaagggcggaagcgcttgataaagaccgctccgcccgcttacggcgcttggaagcgtcgggtgcccgcgtattgtatcaaccggttgatgtgacagacagggcggcggtcatcgccctcgtccgcggcatacaggaggagcacggaacactcgacgggatcattcacggcgccggcgtgatcgccgacaattacattctgaaccagacagaaaacgaacggaagaccgtcatggcgccgaaggtgaaagggcttatcaatcttgatgaagcagcgaaagatgcgcggctggactttttcattctgttttcttccttggcgggaggtatgggaaacccggggcaggccggttatgcggcagccaacgcatttatggacgtatatgcagcccgccgaaatcgtctcgtgcgggacaacaagcggagcgggcagaccctgtccgtcaactggccgctttgggaagaaggcggtatgcgcgtggacaaagagacagaacggctgatgtatgaacagaccggaatgaaagccatgcgatcggcttcaggcatccaggcgctgtacgccgcttttgcctccggagcacaccaggtcatggtggcagaaggcgacgagaaacggattcgaaaaaacctgatgcctgaagcgccggaaccgtcacgcagcattcatgtgtcaaggaagacccacgtccatctgccaaataaagtacaagcggaactcaaacatatgatatcaggcattctgaaggtgaaagaagaagaaatagatgctgaatcagagatgagagattatggatttgattcggtttcattcacgcagtttgcaaatgaactaaataaaatgtatgggcttgaactgacgccggccgtgttttttgaatacccgacagtctttagttttgcccaatacttgctgacggaacatccggatacattcggcccacaggaagaaacagaaacggagaaaccggttgagcgtaaaaaaatgaagacggagccattctcgattccgtcccgccttcctaaaacaaaaaccgcagctgaacctgaagagcccgtggcgataatcggaatcagctgtgcatttccaatggctgaaaatccggaaatgttttgggagaatttagccggagaaaaggactgtatttctgaaataccgccggagcgctgggactggagacagtattacggagatccgcagaaagataaaaatgcgagcaatgtaaagtggggcggcttcattgatgaaaccgctcaatttgatcctttatttttcggtatttctccgcatgaagccgaaatgatggatcctcagcaaagacttttaatgatgcatgtatggaaagcgattgaagatgccggctgctctgcaaaaagcctgtcaggtacaaatacaggcatttttgcaggcacgacaaacagcggttacgctcaggaagcttcaaagttccatatagagattgagggttcttccgctgccggaacggttccgtcaatcggtccgaaccgcatgagctattttctgaatatacatgggccgagcgaaccgattgaaaccgcctgttcaagctcattggtcgctgttcaccgtgcggtcagggcaattcaggccggagactgcggcatcgcgattgcaggaggcgtcaatgctattgtgtcgccggacatgcatatcagctttaataaagcaggaatgctcagtgaagacgggcgctgcaaaacattttccgatcaagcggacggctatgtcagagctgaaggtgccggcatgattgttttgaaaacattatctgatgcggaacgtgacggcgaccgtatttatgccgttatccgcggaacggcggaaaatcatggcggaagggcggcttcccttacatcgccgaatccgaaagcgcagacagaagtcatgataaaagcgtatcagcaagcgaacatcgacccccgtacagtgagttatattgaagcccacggcacgggaacggcgctcggagatccgatagaaatcaacggactcaaagcggcttttgcagcgctttatcaaaaagccggagtaacggcacccgatcagcctcattgcggcctcggttccgtcaaaacgaatatcggccacacagagcttgccgccggcatggccggacttttaaaaattattttgcagatgcagcacaaaacgctcgttaaaagtctgcattgtgaaaccgttaatccgtatatcagcctcgacggcagcccgttttatttcgtccgcgaaactcagccgtggaaagcggcgactgatgatagcggaaatgaactgccgcggagagcgggtgtcagctcgttcggatttggcggtgtcaatgctcatgtcgtgctcgaagaatatgtttctcctgttgaagagaaacaatggacggccggtgaacttcagccgtccttattcattctctcggcaaagacggcggaacagctgaaggaacgtgcggaacagctgcgcagatatttggaaaagtcacattcagctgacggagctcttgcggatatcgcttatacgcttcagcttggccgggatgaaatggaagagcgccttgccgtcattgctgaaacaaaagaagagcttacgaacgcgctgaatgatttcctcagcggcaaggagacggggcagaatttctttacaggccggaacaaagcgatgaaacagctgtttacagagatgacggacaatgcagaaatgagcggggccgtagatcaatggtttgaagcaggaaagtatgcaatgcttgcaaaattatgggtgcaaggcttgcatgttgattggagtaaattgtatcaggacgaaagaccgaaaaaagtcagcctgcctgtctatccttttgcgaaaacacattgctggataccgcacagtgcgcagcatataaggcaccgggagacttacgggactgatacgtccccgcttgagacttatgagcgcctgcttgatgaattggagaaaaacgaaataagcatagaagccgctgtaaaaagaacgatcggtttttacagggattagcgtaatggaggaaaccatatgaaagagtttctgcaccgggttttttctgacgtcaaaaataaaaaaatgacaaaacaggatgcgatcggcattttgcgcgattatgatatgcggatgggacttcgccaaacggattcccttcatccgcttgctcagcagcatatttccgatgaaacgggacagggattctcggcagctttcagcggccgggaattttttctcgctgatgtttctttacagcataaaaagcttatgcctggagaacttcttttggaaatggcgagagctgcggctgttttgacagtaaaggagactgcggctgtccggctgacgcatatcgtgtggtcaaagcccattctgactgaggctgagccgttccatatcgaaatcaggctgatacccgcagagggtgaagccaaaaggtttgagatttataatccattttctgctgattccagtcattatgatgtgtacagccaagggacgattcagccagttgatgctgcgcccggcatgctggatatcagccgcttgaaggaaaacagcggttccctgatggataagcagcaaattgaagccatcactcagaacgataccgttcaatacagtgagcacatgaaaggaattgagcgtatttacgcttcatcaggacggatgctggcagacatatcaattccattgacaaaccaaaaagaatccgcccgattcggcctccctccctgtgtgatgcaaagtgtgacagaggcatgcgcgctgcttggcggcaaagaatataaaacgctcgctccggtttcattggacgagcttttgttttatgaatcttgtcctgacaaggtatgggccgagatacaagagaaggcggggagcttttatattgatttatgtgacggagaaggaaaaatatgggcttctctgtcggggttgaagctgcagcctgtcatcaagacgggcgcttccggaaaaaccaatgccgaacaccgcagtgaacgtttgtatgaacaaacgcttcttcagctcaaaacgctttttggcctgactgcaaaaattgctgtttccaacatagatactgaagagccgctggaaacttacggaatcgactccgtcactgtgacgaaattgaaccgcgaattgtctctgcttttcggtgacctttccaaaacggttttttacgaatataagacactgggctccctggcagctcactttgtcacggattatccgaatgaatgccgaaaatggacaaatgatgatgagcaccgttcaggcatatcagaacaggttttggcaaatgaagattttccggtgcttccgtcgtttatcaagcgaagaaaacggcctgctttttccaatgagaaacagacaaaagaagggattgcgattatcggagtcagcggacgttatccgcaagctgaaacacttgaagagtactgggataacttagcggccggaaaagactgtgtgaccgaaattcccgaagagcgctgggaaaaggacaggtactacaaccctgatcccgaagcggccgtgaaagcagggaaaagttacagtaagcggggcgggtttctgaaagatgccgctttctttgatccgctgttttttcaaatttcaccccgtgatgctttgaatatggacccgcaggagcgtctctttattgaaatgtgctggcaggtgctggaggatgccggttatacgaaggaacagcttgagaatctgtataacggccgggtcggcgtttttgccggcattacgaaaaacgggtacggaatgtactggaaaaacggcggcaccctgcagccgaaaacgtcgttcagttcagcggccaacagagtttcctattttcttaatctgaaagggccgagcatgccggtcgacacgatgtgctcgtcttcgctgactgcaattcatgaagcgtgtgaaaacatccttcgcggcgcatgtgacatggcgattgccggcggtgtgaatgtgtatacgcatccttcggcttatgcggagctcagcgcctatcgaatgctttcaaaagacggaacgtgcaaaagtttcggtgaaggcggggacggatttgttcccggggaaggcgtcgggaccgtgctgttaaagccgctgtcaaaagcgatggctgataaggaccatatttacggggtgattcgcggcactcatatcaatcacggcggcagaacaaacgggtatacagtgccgagtccgagcgcccaggctgacgtgatttccggcgcgcttgaaaaatcaggaatacatccgcggatgatcagctgtatcgaagcccacggcacgggcactgaactcggagatccgatcgaaattgacggtttgacccgcgcatttcaaacgaaaacgtcagataaaggcttttgcgccatcagctcagttaaatccaatatcgggcatttggaagccgcggcaggcattgccggtgtaacaaaactgctgctccagtttcaaaaacgaaagctggccccttcattacattgccgaagcttgaatccgaatattgcatttgaccggacgccgtttgcggtgcagcgtgaattggcagactggaaacggccggtcattgaggaaaacggagcgcagaaagagattccgagaatcgcgggaatctcttcttttggcgcgggcggggcaaatgcccacatattgatagaagaatatattgaacctgatagggagatttctgagccattcacagatgaagatcccgcagtcattttattatccgccaaacaggaggccagcctgaagcagcgggcgcagcagcttcttcaagcgatcagaaaaaatgacgtcacagaccgcagcctccgggatgcggcttacacccttcaaaccggaagagaagcgatggaagaacgtgcggcgtttatcgtgacgtcgacagagcagttagcggaaaaactgcagtgttttattgacggcggaacagacggctgcttcaggggaaaaagcaaacagtataaagatattctagccgtttttaaggatgaagatatgcaggaagccgtccgtaaatggatgaaaagaaaaaaattcgcgaagcttctggaactttgggtaaaagggctgaagattgattggtcagagctttataacggcagcctgccgcatcgcgtcagccttcccggttatccatttataaaggatcgttattggccggacgatgcagcgccggacaatgttcgcggtgctgaaacacattctgaaacatttcgtgaattccgctttttacagaaaagctgggcagaaagcagccgtgttccggctaaggaagtgcggggcgtcatcggaatagccgctgatcaccagacaggaaatttggccgttgagctgtcccgttatttccccgagtctgaaatcattgacgctgcatcaccggaaatatccggggacgcggcccggtttggcggtctgattgatgtgacgggatgcgggacggaaatcaagcatgatgacggctggattcatcgtctgcagtctctcatcgacaacagaaaccgcggccgaaagctacagctgctttgtgtgacaaaggggcttgaaccttttgcgaatgaaacgataaatctctcaggtgcaaaaaaggccggattgtaccggatgctccaaagtgagtataaggatatccgctcgcggcatatggatgcagaacggactgccgaagattccgagctggcaaaccagatcgcagaggagttttttcgcgattctgcagacatcgaagtgtgttaccgaaacggtgtgcgctatcacgcgcggttaaaggaaacaaacagcttagctgaaaaagaattttcatttccgaaagaccatgcgctctggatcaccggagggacccggggactcggatatttattcgcccggcattttgccgaacgttacggagtcacgaaactcgtgcttaccggaaaagaaacaatgcctccgaaagcggagtgggatgatcatatcaaacggaattccccgttttccgataaagtgagaagaatcagagagctcgaacaaaaaggtgtccgaacggaagtgctgtctgtatcttccggccctgaatatgagcaggccgtcagccgggtgaaagagaagatgggaccgattggaggcgtgatacacgcagcgggagccgtagatctcgatcatcccgcctttatccgcaaaacaagagaacagatgatgactgtgcttgaacctaaaactgacggactggaccttttgtatcaagcgctgcacaaggagcctctccggttttttgcgctgttttcttcagtgtccggcgtgatgccggaattaggagcgggacaaagcgattatgccatggctaacgcctatatggattattttgcggccgcaaaaggttttccggtgctgagcatccaatggccgagctggaaagaaacgggtatgggcgaatcaaaaagccgggcctatcagaaaagcggtttaaagagcatcactgacagagatgggctgagcctgtttgatgccgttatggcaggcgattgcggatctgttattatgccggccgtcattcacccggaaaaatgggagcccgaccgtctgatgctttcaaccggccttaccgaaacaaagcagcatgtacagggtgagacagaaagcgtagaggagtggctgacgggcatttgctgccgggaattaagactggagccgtcaagatttgaatctgatacaccgtttcaagattacggagccgattctatcatgcttgcccaagtgtccagagcgatcggaaagaggatcaaagctgaccttgacccggcggtgctgtatgaataccctacggttgctgcgctggcgggatggcttgaaacggcatatccggaaatcaaagctgccgtttcaaaaccggttcagcctgtaatcccggacgttcccaaacaaacagcagccgctgtcattcagccttctggcgctgcagcggcgcaagacatcgctgttgtcggaatgtcctgccgttttcctggagctgaatcaattgaagcttattggaagctgctgtctgaagggtcgtcggctattcaaagggtgccgaaagaacgctggaaaacggagaaggcggattatgcgggccttttaaaaaatgtaacgcattttgacccggagtttttccttattcccgaagaagacatcaaggcaatggatatccagtcctttcttatattagaagaggcgcttcatctgttcagagacagcggttactctttacaagaaatgaaaggcaggtcagccggtgtctatttaggaggacgcggcggcagtatgcctgacgaaaaccgtctgaagcatgcaaaaaatccgatagtcgccgccggcccgaattacttggcggccaatctttctcagttctttgatttgaaggggccgagtctcgttttggatacggcctgttcttcagcgcttgtcggtatgaatatggcgatacaggcgctttcttgcggtgaaatcgactcagcggtggtcgggggagtcagtctgctggaatccggtcaaacccaccggatgttcgaacttcgcaatctgttaagcgaagagcctgcgtttcatatttttgaccgccgcaccggaggcatcgtattgggagaaggcgtcggaatggtgtatttaaaaacagcggcccaggctgtaaaagacggggaccggattcatgcggtcattaaaggcatttccgtaaacaatgacggcagaaccgcggggcctgccacaccgaatatacaggcgcagaaagaagtgatggccaaggcgcttgccaaaagcggcagaaaagcggaggatatcagctacattgaagcaaacggttcaggctctgaagtaaccgaccttttggaactgagggcgattgaagcggtgtaccgtatgcaaaacagcgcgccttgcgaattggggtcgatgaagccgaatatcggacacccgttatgcgctgaagggattgccggattcattaaaacagtgcttatgctctcgcgccgaatgcgtgtgcctttcctttcgggcaaagagccgatgacgcattacgatctgtccgcctcgccgttttatttttcgcacgttctgcgtgaatggacggattcaccgcggattgccgccgtcagcagtttcgctgacggagggacgaatgcccatgtcatagtggaagcctgggagcaggaggcgtataccccggttagaaagcctttgccgagacaggaattaaaacgccggcccatccgtccggacaaagctgaaaacctgcatgaaaacgcacatgaatcccgcccgaatacgttttggaaacaaatgaagacttactgattgcgctgaaaattgaacgtcgatatggaggaagttcatatgcaagagcagcttcttattaacaatcagcatcccgttctgaaacatcataaagcctatggaaaggaactgctgccgggtctggcttatattgacctgatctatcagactttcagagaaaacggtttttttcatgccggccttgaactcaggcacttatcgatttttcaccctttagctcctgaacagggagaaacaatcctgctttccgttgactgtacagagaacggcgaagggcagtggaaggtagaggtgaaagggcaaaaacaaggtgacgaagcagcagagacaaagatatatgccgcggcgcaaatgcattccgtcaagcccgccggcttccaagagagcgtccggatggatgccgtaaaacaaacggcggcagaaataccgcttgaggatatttacgcggaatgcagggatcaagaactggttcattcaggaatgatgaaaggctgcggaagcgtctaccagactgaaaaagagatttatattgatctgtcggtgcaaaaggatcagctggaacatgcagaagaggcgatgtttcatcccgcattgatagatgcgagcagcatcggctccaatgtatatctcgctcctttgacgagggaggaggggcaattatttctgccgctgttttatgaatcattttattgcgccgaattgctgcagacgacatgtatcaccaagataaaaaaagaatccgtcacacgtaagaaagatctcgtttacgtgacaatggagtttttcaatgaggaaggcagaaaagtcggcgaactgaaaaacttcgccaataaacgggtgagggacccggaactgatcaatcagaaacggcaaaagaaagaacctgacgggcggaatgccgtcccggctccgcaagcggaaccggcgccttccgagccccgccgtgcggaggcttccgccggccttactgaacagtgcatcctttatttaaaagaattgcttgccgcccgattgaacaaacctgtgaaagagattgacccggatatcggctactatgaaatggggctggattctccggggctgttggacatggtaaaggaaattgaacgaaaaatcggaacgcagcttctgccgacgctgttatttgaatacacgacaatcgcggaattggcgggatatttgcgcgaacattacggagccggcttcggccatgctcaaagcgggcatccaaatgctgaacctttgcgccgggaaaaaaagaggacgacccaaaaccgcgtgaaaaaatcggcgtcagccggaacgcagaatggagatattgcgatcgtcgggatggcgggacggtaccccggcgccaaaaatcttcgtgaattctgggcaaatttaaaaaatggagaaaacagcgtaacggaagtgcctcgttcccgctgggatacgaggaaatatgagcatttgcgatcgccgtccggcaagccgatttccaaatggggcggttttatagacgatccggattgttttgatgcgaaatttttccggatttctccgcgggaggcagaagctaaagatccgcaagaacgattgtttttagaaacatgctgggaaacgattgaggatgcaggctataccccggaaacaatcgttcagccgaaagggccgaataagagaatgaacgtcggtgtgtttgccggggtgatgcatatggattattctctcgccggcgctgaagctgcggccaaagggctggtctttccttatcccttgaactatgcgccgatcgcaaaccgggtttcatatttctgcaattttcacgggccgagcatggcggttgacacggtgtgttcgtcatctctgacggccgtccatatggcggcggaaagtctgagacgcggtgaatgtgaagcagctcttgccggaggcgtcaatttatcattgcacccgacaaaatatatcacatacggcttgatggatatgcattcgagtgacgggctgtgccgcacgttcggcgaaggcggcacaggctatgtctcagctgacggcatcggggccgtgctgctgaagccgcttcacaaagccgaagaagataaggatcatatttatgcggtgataaaaggcagcgccgtcaatcacgtgggaaccgtcagcgggattaccgtgccgagcccagtggcgcagggggatatgatagctgaatgtcttgaaaagacggggatcgatcccaggacgatttcttatgtggaagcgcatggaaccggaacttctttaggagatccgattgaaatacaaggtcttgttaaagcttaccgcacgtttacggaggatcggcaattttgtgcgatcggttccgttaaatcgaatatcggacatgcggagtcagccgccggaatcagcgggcttcataaaacggttttgcagctgtttcacaaaacgcttgtcccttctttgcactcagagacgattaatccgtatctccgtttagaggactcgccattttacgtgcagcaaaaaaccgagtcatggaaaaagccggcgtatacagagaacggcagagaacattcctgtccgagacgcgcaggcatcagttcattcggggcgacgggttcaaacgttcatctcattttagaagagtacaggcccaaaaaccccggcattacggagaatcaagagagaccgtatatcgtgcctctatcagcgaaaaatccggagcggctgaaggaatacgctgcccgcctgctgatgtttctcaaagataaagcgcttgaaggaagcgggtcgctttatgacaaaacagatacaatgcaaaatcagctggaaaatgcgctgcgcggtgctctggcggaagttctgcatgtagaggccggctcggtagatggtgaacaggattggaaggaattcggcttggatgtcatgcagctgacacagttttctgagcggctgacggatcaatacgggctggcaatagacatgactgatctcatacagcatacttccgtccggactttagcagaatgtctgacaaacgatgagaaacataagaatattctttccggtcttttcggtcagtccggcttagagaagcagtctgatgaacctttttccctgcggtcactggcgtatacgctgcaaacgggacggctggcaatggaagaacggcttgtttttttagtgaacgatcaagcggacctgatcaggaaattaaccgaatttacagaacgaaaacggcagattgacggctgctttcaaggccggtctgatagcggaacggaaatcaggggtttcctgaatgatgatcaggatacggaggagctgatccgaaaatggacggacagcggcacttacaaaaaacttgcggagctgtggtcaaaaggatttgagatagactggacgcggctgtatcgggaggagaaaccgcgcaggatgagtctgccgacatatccgtttgcgaaggagcgctattggataccggagcccgatcatcccgtcacttccgtaaatacagaaagcaggcttcacccgctgcttcaccgcaatacatcagatttgttagaacaaaaattcagcacggtactgaacggagatgaattcttcttagccgatcatatcgtccgaaacaagcgtgttctccccggggcggcttatcttgaaatggcgagagccgcggctgaactggctgccgcgccgttagccgctgaatacacggctaaaaccggcatttcgctgcggtatatcagctggatacgccaggccgttcataaaaaagagccgctgcgtatgacgacaggtctttccttagaggataacggcaatatttcatttcaagtgtacagcaatgaaaacgattcagacatttattgtgaaggcagtgctgtgattgagccgctgtctgaggcggcggttttgcatattgaacagctgaaagcgcgctgccgcaaaaaagtgctgtcaaaagaagactgctatgcggcatttgcaaaggcggaaattgtatacggaccttcacatcaaggaattgatcacatttattgcggggaaaaagaagccttggctaaattggtgctccctgcttccgtttgtgatgaggccgaacagtttgtgctccatccgagtctgattgattccgcttttcaggcggccatcggcgttatgaatgaagataaagcgggttatccggagcagccgttaatgccttttgaattgcatgaactgaccgtttttcatccgtgcagtccaaacatgtgggcggccgtatttgtgacgcatgaaacacgggccgtgcgaagaatggacattgatatatgtgatgaacgcggcaatgtgtgtgtaagaataaaaggattttctgcccggatggccgaaagtgcgccggccgtaaccgataataagcaatacgatctgccgggtaaccttaccggagccgtcaaactgatgcaggtatgggacgcggaaccgatagacaaccaaaccggcttccccatttctgaagcaaaagctgtcatcataggcggtacagacgggcaggcggacgcggttttacgattgtttcctaaagctgtgcgatttgatagcagccaaagtgcttccgttgaagtgatatccgatcggctccgccgtgtcggtgagattcagcatatgatctggtttgcccctcagccggctgattcttacatccatgatcaaaaaagcggggtgctgcaaattttcagagcggccaaagctcttatcggtctcgggtatggaaaagagcagctcgggatgacggtgattacgcaccaagcacagcctatcacccaatatgatgaggtgcgtcccgctcattccagtgtgcacggtttcgtcgggtctctcgcaaaagaacatccgagctggcacatccgtctggtcgatcttgaagacgggggggatttccctgcagaagacatattcagcctgccccgcgaccgtacgggtaaagcatgggtgcgcagacatcaggaatggcaccggcctcaattgcttccggtccaaagcgggccgtctgaaagtgttccttaccgatatggaggcgtatatgtcatcatcggcggtgcgggaggcatcggcgaggtttggacagattatatggtgacggcgtataaagcccgagtcgtctggatcgggaggcggccgctggacagccggatacgccaaaaaatagaccggtaccggccatcaggcccggctcccgaatatatagcagcagatgcttctgatcttccatcgcttcagcgcgcctatgaacagattaaaaacacatacggcaccatcagcggcgtcgttcattcagcgatggtatttgcgaatgaaagcgtaaaagatatggaagaatcacagtttcacgccggccttgcggcgaaagtggatatttccgtcaacattgccgaagtatttgcgaaagagtctttggactttattctctttttctcttcggttatttcatatattaagaatccgaatcaaagtcattatgcggcggggtgcgcatttaaagacgcatttgcccatgagctttccgggcggctgtcatgcccggtcaaagtgatgaactgggggtattgggagcgggctgacaatcacatttctgaagagtttgacagactgagtgcaatcggtctcggactgatcagccgggcggaagggatgcaggcgctggaaactctgctgacgcagccgatctcccgcatggggctgatgaagctgaccaagccgattccgatcgagggaatgaaccctcatgaatttgtgactatctgattgcctgtcaaaatgacggagcaaatttaattttcttaggaggataaggttttgggtaagggagacaaacaaaaagaccgtacacagttatccttaagaacagaaataagcaatcaaatgaaagaattgaatcagcttttgctgcaagtgctgcgggtgacgctgcgttcaatgggtctgaccggcgaagcgccggcggcttcctgtctgcctttatatgagcgctggctggaagaaagcatccgtcttttagacagcgatcttaaaagcggtgaaacggccgcgatttgggaagagtggcataagaagaaaaacgaatggctgaaagatccggatatgaaagcgcaggctctgctggcggataccgtcattcaagctttgcctgacattttaacaggcaaaataaaagccactgacgtgatgtttcccgattcttcaatggagctcgttgaaggaatctataagcataacattctcgctgattattacaacgatgtgatggcaaatgaagcgtgtatttatgtggaaaatgtaattaaaaacaatcctgaggcaaacatccgtctgctggagatcggagcgggcaccggcggaacgagcagcacactgtttaaaaagctccgcccctatcaaaaccatattcaggaatactgttataccgacttgtcaaaagcttttttaatgcatgccgaaaaggaatacggcgcggacaatccgtatttgacgtatcagctgtttaatgtggagaagcctgcggcgggccagggattacatctgagaacctacgatatcgctatcgccgcaaacgtgctgcatgccaccaaaaatatccggaaaaccttacggacggcaaaagccgtattgaaaaaagacggtttgctgctcgttaatgaactgggcggacatacgccgtttacacatgttacattcggcttattagagggctggtggctgtacgaagacgaggcgctgcggattccggggtgccccggtctttatccggaaacatggaaatcggttttaatggctgaaggctttcattccattcaatttccggctgaaaacgaacgtctgcacacccagcagattatcacggcgaaaagcaacggagtcatcaggcagagcagggaagcttacaccgcgcaaaagcgccaatcaaacgtaccgcgaacattctctgatcgtcagctccccatcaaacaagcgggagaagggctttcggaaaagacagctgcttttctgataagggctgcggcaaaagtattaaaaatgccggcagaagagataaatccgctggctcctctggatgaatacggtattgactctattctgatcgttcagctgacgaacgagctgcgggatctcgtccctgatatcagcagcacgctgttttttgaacaccgaacgatagaagagcttgccgcatacttggctgaaacgaaggagcgcgaactgcttgcgcgattttctgaagaagtccgtcatactgaagcggtatcatcaggctctttgcttgaaaaaagcacagagtatctgaaacagatcgtcagcgtcatcttaaagatgccgattgaggacgttcaagcccatacgccccttgaagaatacggaattgattccatcttaatcgtacagctgaccaaccgcgtgcgggaagacgtccctgatatcagcagcacattgttcttcgagtatccgacaatcggcggattagcggaatatctcgtcagctcaagacaggaagatatggctgggattttcaagacaaataaagaagccgaaaaggtgccgcacactctacagaaaaagcaaagccgcaaaaaaagcgccggattgacgaagcgccaagcggcatctttttctgaaaaagcgccgcccgcctccgaaccgccgtcaaaacaccttgaagtggcaattgtcggtcttgccgggaagtatcccggagctgaaaatgttaatgagttctgggaacggttaaaaaccggtgaacacggaatcaccgaaattccgaaagaccgctgggattggcgggactactatgatgagacaaaaggtaaggaaggccggatgtatacaaagtggggcggctttttaacagacattgataaatttgatccgctgttttttaaaatctccccgaaagaagcggagcgcatggacccgcaggagagactgtttctggaaaccgcttatgcggcccttgaggatgccggatatacccctgattcactatgcgccggtaaaaaggttggtgtttttgcgggtgtcatgaacggcaactatccgacaggggcccactaccactttatcccgaaccgcgtatcctatgtgtttgattttcacggtccgagcatcgcggtcgataccgcatgctcctcatccttaaccgccattcatctcgccgcagaaagcatcagaacaggtgcatctgaatgcgcgattgccggcggcgtaaacctgattacagatccggttcattatatcggactgtcttctatgagaatgctgtcgccgtcaaacgcgtgcaaagcgttcggtgataaggctgacgggtttgttgacggagagggcgtcggctgtatcgtgttaaagccgttgaagaaggctgttgaagatcatgatcatatatacggtgtcattaaaggaagcgctctgaacgccggcggcaaaacgaacgggttcaccgttccgaatccgaatgcacaaggggaagtgatcgcagacgcgatggagcgggcaggaattgacccgagagcgatcagctatctggaagcccacggcaccggcacttccttgggagatccgattgaagtcgcggggttaaccaaggctttccgccgctatacggatgcaaagcaattttgttccatcggttctgttaaatccaatatcggacacctggaaagtgcggcgggcattgctgccgtcaccaaaattcttcttcagatgaaacacggatatctggtgccgtcgctgcattcaaagcagctgaacccggaaattgattttgaaacttctccttttatcgtgcagcaggaaacggcggaatggagacggccggtcatagaatctgaaggagtaacacgggaatatccgagaatcgcgggtacatcttctttcggagcgggcggggcaaatgcccatctgctgatagaagagtatgaaccggctgaaatgacttcggcggactccggccgtccggcgctttttgttttatcggcaaaagataaagaccgcttgcgcgagcgggctctgttgctgtcggatgccgccggaaacggaacaattacagatgcaaatctgcttgacgcggcatttacccttcaagtcggcagggttcagatggaagaacggctggcgatgacagcggactctgtttctgaattggaacagaagctgactgcttttctgaataatgccgattccgtaagcggggtgtttacgggccggagtgatagtgctgtcacagagacggaaggcacagtcggtgattggatggaaaaacgtcaatttggcagtcttttgaatgcctgggtccacggggcgcccgtcgattgggcatctttatataaaggcgcgctgccgcatcgtatcagtctgccgtcttatccatttgcaaaagaaagctactggatgaagcgggaagaaccaaaaacaggaacaactgaatatgtgcatcctttcctgcatgaaaatacgtcaaccttggcggagcaaagctatcatacatcttttacaggccgggaacacgttttccaggatgtgagaggagagcgggttctgtcggcagccgtttatttagaaatggcgcttgcggcttatcatcatgcggcagacagctctgaagaaaaagagatatggatccgaacggcggcatggactgacccgattaccggcggacatcacggtgcgggcgtcaatctctcccttctgtctgaagacgaggaaggcatccattatgaaatatacagtgatgaagagaagctgcatcattatggaatcatcggtcaagggaacgtacagccatcccgcatgcttgatattgcctccttacaaaaagactgtcgcccgctgtcattcgattatgaaacaccaggcacatcaggtgtaacgatcagtaaggagttccgcaccgttgaaaagctttatacgggagaaaatgcgatttgggcgaagcttgctcttacagatgaaagcggccgtaatccgggatatcatctaccgccggaatttctggacgcagcttttcatgtcttggcaaaaacggagccgtcagtccatatcgtgcctgaaacggttgaagaactgcgcgtcatgcgtccgtgttcatccggcatgtggatgtatatgaataaaaagaatcaaaccggctgtgacattcaattttgtgacgaaaccggcattgtatgcgcagaaatcaaaggggtgagaatgagacagccgtctcagcaggatcacgggcaagaggaacactccgagatgatgatatttgaagaaaggtggacgcagcagcctctgaagaaatccattcatgaagagctgaaaacggtcatctgttttcttacgggagaagctgccagaaaacatgcttatcggtctttacaatccctttatccgggagccggcgtgttttttatttcacagggtgaggaaactcaaaagctttcaaacacgcattatcaaattaaaatcactgacggacaagcatatcaagaaacgtttcggcatattgaaacggctgcaggcaaggcggatgccgttttgtatggatggccgcttgaagatgaaaaggccgtgaaagactattccattctgtatcatgtgatccgcgcagctgcttctttgcgttctaaaccgaggcggatccttctttccgctcagtgcgggaccgaaaccgatatcagttacgccgagtcatggatcgggctggaacggtcgctgaaactgatcctgccggagacggatacggccgcggtttattttggacaaagaggaccgtttgaaaagctgatccataatgtatgtgaagagcttcacagcgggtcgttccgcagtgtcatgtacagtggggaaatccgtcacgtcatggaaatgaagcagacggatattgcccctgttgagaggcgtgtgataaaaagcggaaaaacgtacttgattaccggcggatgcggaggtttgggcttgttatttgccggatattttgctgaaaaaggaccggttacgctcattttgacggggagatcagcggcaggcggcccggtgctgcacaagataaagagattggaagaatcaggcgccaaggtgttttacgtgcaggcggatgccgcagatcaggctcagatggagaaaggtttgcaagaagcgaaagagaaaggatgcgggccgattcacggtgtcattcacgctgcaggtcttcaaggcactgaaagcattctggagaaagatctgcaaacctttcagcaagtcttatcgccaaaaacggacggcacagcggtgttagatcaggttctgtcacgggagccgcttgacttcttctgttgtttctcttcttcttcagcgattttaggagacttcggttcttgtgactacgcaatggggaaccgcttccaaatggcttttatccgccaccgggataaacttgtgagcctcggactcagaagcggcaagtcacttgcaatcaattggccgctttggaaagaaggggggatgcatgtcggcacggcggaaagcaccgatatgtatttaaaatcaagcggacagcgttatttatatacaaaggaaggactcgaagcttttgaaacattgttagtccagccgtccagccagtatctcgtcctggccggttttccgtcgagggccaaacgcttcctgcagatagatcaaggcgaacggccgatttcgggttctgtaaataggaacgtcccgttttcaggaaggcggagtgaaatgaaaggctttacactggaagaatgcgtaagctgggatgtgaaggaactggcggcggggcttttgaaaatagacaagaacagactgacggatgctgacaatctggctgatttcggctttgattctatcagtttggcggaattcgcctcttctttgtccgctcactacggaattgaagtgaccccggccctgtttttcggacattccacactggagaaggtcgtccgctattttctgacggaacacaagtccgtcatagagcatgtctatgaagaaaagaaacctgaatccgcagatcaatctgtctttgaaaaggcaggaacggaaaagcgaaagaagcagaggggaagaaataagctgaacgccggaaccgagggcagtcaggcagctgattccattgccattatcggcatgagcggccgctttcctcaggcgcgcacggcggacgagctgtgggacattctgtttcaggaaaaggacgttgtcgcaccggtcgcaaaaaaaggcttcacaagttcaaaatggaaactcggcgctgtaccgggggcggacgaattcgaccctttattttttgaaatatcgccgagggaagctgaaacgatggatccgaagcagcggctgctacttcaggaagcgtggcgggcccttgaggatgccggctacggcgccagtcacatcaggcagcagacgatcggtatgtttgtgggtgcggaagaaggagattatcaccttttaacacgggacaaaggcaatgtcacgtctcatcataacggtattttggcggcgcggctggcttatcacttgaatttatcaggtcctgtgatggcgataaatacagcatgttcttcggggctcgtttctgtccatcaggcggtattaagcctgcagaataaagagtgtacaacagctgttgcggccggggtgaatatcatgaataccccggacttttttgaaacgatagataaagccggaatgctgtcggaaaacgggaaatgcttcgcgtttgataaaagggctgacggcctggttcccggggaagcggctgcggcggttgttcttaagccgctgagagaggcggaagaagatggcgatccgatttacggggtgattcgggcgagcggcatcaattatgacgggaaaacaaacggaattaccgctcctagcggcgtcgcgcagacccggctgcttacttccgtttatgaccggggccgtatcaaccctgaagatatcgaatatatcgtcacacacggcacgggtacaaaactcggtgatccggtggaaattaacgcgctttatgacgcattttctgcctatacaaacgaagaagcattttgcgcgctcacatcaattaaaaccaatatcggccacacgtttgccgcgtcaggcattgtcagtttgatcagtcttttacaggcattctcccgtgaaatgattcccgccagtctgcattgcagcggggaaaaccgctatatcaactgggagaaaagtcctttttatgtgaataaaacggctaaagcgtggccttctctgccgggtaaaaaccgaatgggggcagtcagcgcattcgggatgagcggaacaaacgcccatgtcgttatggaaagctataagcgcagcgcttcacctcatccggatgcccctgcttatttactgactttatcagcaaaaacaaaggaggcccttcaggaaaaaatcgaagatatgatcacttgggcggaaaatggcggactgaaagaaaatgatctagcccagctcagctatacgttgctaaaaggacggcatcactttaaccatcgcgccgccatcgtggttcaagatgctgatgacgcagtgtatgtatggaagcaggcaaagcttaatgaacatcatccttatgtgttttcgggaaaagtaccgcagcactttgcaggccgacagcatattcaggagcacataatagaagtgctcggcaagtgcagcgcttcatattctgaccatagaaaatatcaggaactgttatgcgtgctggcagatttttattgtcaaggttatgaaattgaaggggacttgctttatggcggacctttgccgcgaatcggcaatctgccgggctacccgtttgccaggcagacgtattgggcgtccgatcgtcttcagggagagcttgaaagccggaattcagctgaacgtgaaaagcttcacccgctgctccatgcgaatacatcgacctttaccgcccagcgctttacttctgttttttcagggcgtgaaccgttttttgccgatcacatcgtcaatggaaaaccggtgcttccgggcgcggctgctttagaaatggcccgggccgccgttacacttgccgctgagggcttgccgggcggaaaagcgggtgtccggctcaaacagatcgtttggctccgtccggtgacggcgctttctgaaggcgtgacgcttcatgtaaaacttcagccggaagaaaacggagacatcgcttttgaagcgtatgccgaaggagaagagccgcttgtctttttccagggaaaggccgtgctcgaagagacggagcgtgctccggtactcgatgtggaggcggttcaggcgcgctgcggcggccggcacatgtcaaaggctgagtgttatgaagcattcgacagcctcggcatcacctacggaccgtctcatcaggcgcttgacgccgtctatgccggaagcggagaagtgctcgcgaagctcactcttccgccgtccgcccgcgaagaaaaggagccgttcttcctgcacccgagcatgctggacgccgcccttcaggcttctatcggtctcgtgctctcagacggttccgcgtccggacggccgtttctgccgtttgccctccgggatatgcaggtgttttctgcgtgccgggagacgatgtgggcggtgctttcctcagcggacggcgcctatcatattgagctgtgtgatgaaaacggcgaggtatgcgtccgattgacggggctcaccgcccgttttctggaagaggaaacggagggaaaaccgctcttgcttcagccaaagtggcaggaatcaccgccgggtgaaggcggcggacaagcagagtctttcagatacgtgacgctgtatggcggaatgaacgctgaggacataaacggcgccgtatgtgcggctgacggggaaggtccgattgaagaccgttatgacgcctgcgcggcggagctgtcagcgatcgtcaagcgtcttatcaaagaaaaacagaagggaaaaacgctgatccagcttcttgtccccgacaggggggaagacaatgtattggcggggctggccgctttcctgaaaacggctcaccttgaacatccgaagctgtacggccaagtcatccaagccgatccggacgagccagcatcatcgcttcttgccaagctgaaagaaaaccggacgcaccctgaacaagcggaaatccgttatgaagccggcaaacgtctcgtcagaaactggcgtcacctgcctgcgcttcaaagcggcgccgttccgtggaaagacgaaggggtttacctcctcaccgggggagcgggcggcatcgggctgattttcgctgaagaaatagcctcccgcgtcaaaaacgccgtcctcatattaacgggaagggcggaagcgcttgataaagaccgctccgcccgcttacggcgcttggaagcgtcgggtgcccgcgtactgtatcaaccggttgatgtgacagacagggcggcggtcatcgccctcgtccgcggcatacaggaggagcacggaacactcgacgggatcattcacggcgccggcgtgatcgccgacaattacattctgaaccagacagaaaacgaacggaagaccgtcatggcgccgaaggtgaaagggcttatcaatcttgatgaagcagcgaaagatgcgcggctggactttttcattctgttttcttccttggcgggaggtatgggaaacccggggcaggccggttatgcggcagccaacgcatttatggacgtatatgcagcccgccgaaatcgtctcgtgcgggacaacaagcggagcgggcagaccctgtccgtcaactggccgctttgggaagagggcggtatgcgcgtggacaaagagaccgaacggctgatgtatgaacagaccggaatgaaagccatgcgatcggcttcaggcatccaggcgctttacgccgcttttgcctccggagaacaccagatcatggtggcagaaggagatgaaaaacggattcgcagccatgttttcgatctgcgtgaagaacaaagcgccgccgcaaaagctccggcagagacagatgcaggagatctgaaagatcgggttcaagagaaactaaagcgtcatgtatcagatcttttaaaggtaagcatgaaagatattgaggctgacagcgaactgacggaatacggatttgattcgatcatcttcactgaatttacaaatctattaaatcggtcttatcagcttgagctcagcccgactatcttctttgaatttccgacattgcgcaaactgagcggccatttgatatctgaatggaaagaagcattcagcggcttagaaagagagaattttaaaaccgccccaaaagccggaataagaaaagctgaagctccggcggccgttcatgtcaaacgggaaacgcccgtatccgtaaaaggaaaatcagaagaaaaaaccgaaccgatagccattatcggaatcagcggtatttttccgcaagcgaaagacatagatgaattctggacacgtttatcaaaaggagagcattgcatcacagaaattccccgggatcgctggaattggcgcgaatattacggcgatccggcagcggatgcaaataaaacgtcaattaaatggggcggttttatagatggaatcgccgggtttgacccgctgtttttcgggatatctccgaaagaagctgaaatgatggatcctcagcagcgcctattaatgatgtatgtgtggaaagccattgaagacgcggggtactcggcaaaacggattgccggaacaaaaaccggcattttcaccggcacattgggaagcggatatcaaaccttaatcaataaggcgggtcttcctgtcgaggggtatacgatgaccggaatcgtgccgtccgtcgggccgaaccgaatgagttattttcttgatatccacgggccgagcgagccgatagaaaccgcttgttcaagctctttagtcgccattcaccgcgcggtaaaagccattgaaacgggagattgtgatatggcggtcgcaggaggcgtcaacacgatcgtcacgccagaagggcatatcggttttcaaaaagcaggcatgctcagtgaagacgggcgctgcaaaacattttctgatcaggctgacggttatgtcagaggagagggtgccggcatgattgtcttgaaaaagctttcagaggctgagcatgacagggatcacatctacggcctcatccgcggtacagcggaaaatcacggcggacgctcagcgtcacttaccgcgccgaacccgcaggctcagacggatgtgctgaaaagcgcttatcaaaaagccggtattcagccgtcaacgatcacttatatagaagcgcacggaacaggtacggcgctcggagatccgattgaaatcaatgcattgaaaaaagctttccaaacagacggggctccgggcggatattgcgggattggctcagtgaagacaaatatcggacatttggagctcgcagcaggcattgcgggcgttatcaaagtattgatgcagctgaaacatcggacgctcgccaaaagtctgcattgcgagaacatcaatccccatatcaaattgaaggacagcccgttttacattgtgacagaaacaaaggagtgggaagcgctgcgtgatgaaaacggccgggtcctgccccgccgggcgggtgtaagctcattcggtttcggaggcgtcaatgcgcatatcgttattgaagaatacatgggcaaaagtgagacggaacagccggaaacccgtgagaaagcgtcatctctttttgttttgtcggctaaaaatgaagagcggctgaaagaaagagcgcgtctccttcgcgattttatccaaaacggatcatcccgccatatcgatcttgcagatgttgcatacacactgcagaccggacgggacgcaatggaagcgaggctgggaatcattgcaggctccgcagaggaactgactgaaaaactgaacgcgtttctgacgggaaaaaacagcgaagatatcatcagcggccgtaaaaaacgcgagaataacacgatctccatgttctcagacgatgaagacgcagctgacctcgtcagcgcctggattgagaaaaagaaatacaagaaagtgctgcggctctgggtaaacggatttgacacagattgggagcagctgtatacggacagtaagcctcgccgcatcagcctgccctcctatccgttcagagcagaccgctattgggtgccgaaacgggagcagctgccgctttcgaatcaaaaaacagtagtattgcagaaaacatgggagccttgcgaggcagtgtcttcatccgagccattcagcaaaatagcgctcatcgtctccgaggatacaaaagaccttgccgccgaggtgaaaaaacagctgaatgatgctgacattgtgcaggaaaatcagctcatctctttcttacaggatgcgaatgcggccatctattccgggtttattgacttcaccggctgcggctcccgacaaaagcggcaggacatcagctgggtggcatcgctgcagcagctgattgaatacggccgcggaaaagaaaacatgaaaatgctttatcttacaaaaggccttgaatccttcaaaaataatgcggccgctatgcatggtattgaaaaagcggggctttatcgcatgctgcggcatgaatacagccatattctcacctgtcacgccgatattgatcctgaagagccgctggagcagacagccgcttttattaaacaagaaattgaatcagacttaacggaatctgctgtttgctacagggacggcatgcgcttcagctatgttcttcggcagactgatcagattgaaccagaagccgtgcaaacagaccggactgtgtttccaaaagacgccgtcctcatgataaccggaggaacgcgcggactcggcgctttatgcgccaagcatttcgtttccgcatacggtgtgaagaaactgcttctgacaggcagaaaggagctgccgccgaaaacagagtgggatcttgagcaaacagaccctgtcgtttcggaaaaaatacagcttatccgaaagctggaatcacagggcgtaaaagtgtgcgtctcagcagttgatctgacggataagcaggccgtcggacggcttataaaagaggtaaccacaacgctcggacctgtcggaggcattctgcattgcgcaggaattgcggaccgtgaaaaccctgcttttctccgcaaatccaaagacagtatcgcgcgggtgctcgcaccgaaagcagacggcctccgcggtctgtatgagagtgtaaaggatgatgcgccggcatttttcgtcctgttttcatctgtctcggcagccgtcccgattcttgcggcgggacagagcgattatgcgatggctaattcttatatggactattttgcagaaaacaatgagggcggcatcatgagcatacaatggccggcatgggatgagacgggcatgagcagggatacaaaaagcgggatgtatcagcaaacgggattgctgcgtcactctgacgcggaaggtctcaagatgcttgattacattttaagagaaagacccggaactgtcgtgctgccggcacaagtgaaaaatgattgggacatcaaagcgcttgaaaacgccaagccagccgcccataaaggaatgagaacagcttccaaacctcctgaaacaaaaaaacgggtccataaccggactgatattcaatcttggctgaagtcgcttttggcaaaagagctgagtatcgatgaaacgcatatggatatcgatgtgccttttcaggaatacggaatggattctatctttctggcgcaagtgctgacaaagatcgatcaaaaactgccgtccgtttcaattgatccgactgtccttctggaacaccctaccatagaacagctcgcggattatttagccgcacattgtccggaagctttttcggcagatgcagcggttcccgcggagaaggtccctttgcagaaaacgccgaaacagagcaaaaaaacggcagataagcccgggaaacggggaaaggttgcgatcatcggcatggcctgtcattttccggaagcgggggatataaaagaattttggaagaatctccgcagcggaacggatgccgtcactgaagttccgccggacagatggaacgccggggaacactatcagccgggtgaatatcaagaaggaaaaagcatcagtaaatggggcggttttattcatgatattgatcaatttgacccggagtattttaatatttcagaaacgctggcaccgatgatagacccgctgcaaaggcagtggctcgaagtgagcgcggaagctttggccgatgccggttatcaaaaagaggatctctggggccgccgtatcggcgtttttgccggtgcaagggcaggtgcgtttcatcagaaatttcaatatttgcaaaaagacgcgattattggcgcggggcaaaattttattaccgcacatatggcgcacatttataactttacagggcccaacctggtcgtagatacggcctgctccagttcgcttacggcaattcatttggccgtgcaggctattcaaaatggagaagcggaggcggcctttgcgggcggggttgacattttgcttgatgaaaaaccttttctcacaatgagcgcggcgagaatcttatcgccaaatggccgttcaaaatctttcgatgccgatgcggacggaacaggaatcggagagggctgcggtgtgctgatgctgaagccgctcgaaaaagcgatagaagacgaagataaaatatacggcgttattgacggctctgcgataaataatgacggcagcacaatgggggtgactacgccgaatccccgggcgcagcaggacttgattgagcaggcggttcaatcagcggaaatcgagccggacaccatgacatacgtagagacgcacggaaccggtactttgatcggcgacccgattgaattaaaaggattaaccaatgtcttgtctgcttattccgatgaaaaacaattttgcggtgtagggagcgtcaaaagcaatatcggccacttgctgagtgcggcgggcgcggcgggaatcatcaaagttttgctggcgattgccaatgaagaactgccgccgactttgcattgccataaaccgaacccccgctttcaatttcatgattcgccgctttatcctgtgcttgagctgaagcggtgggacggaaaaaaagagatactcagggccggggtcagcgcgttcggtttgggcgggaataacgcccatatcattgtcagcaacgaaggaattccgaaagaacgaaaagcgaccatggaaccgaaaggcggccagacagtataccgaaaacagcggtattggcctgaaaaagcacagttgtccgaagcggaagaaaatgaggcgggcacagaagcaatgtttgaaataagcgaggtgtgatagattggcagttgccaccgatcaagtcaaaacgttcctgcagaaaatcagccatacgaattatatcgtccgggatcatcgcgttcaccaaatccgcgtcctcccgggcgtgactttaatagatatgctgtatcggctcgccgccgggtatctcggtgaaaggcctatagaattaagacagattatttttaagcagcctgttgtaacatctgaagagtttgataaacacctgtatgtcacctttacgccggcgcgtgacagctggaaagttgagattacaagcgaaaaagcaaaaaacggcacaccgcttggcggaaaacgggatgagaatatggaatgtcagctttatttgcaaaaagacacgccccgggcaaaagagctgaatattgaagcattcatgaaaaacgcaagccgaaaatgggacatgcatgacatttacggaattgcaagaagaagccatattgagcatggcgagtttatgaaaaatgaaggggccgtttatcagcttcaggataaagaagaattaatggagctcactctgagtgatttggctgaaggattccgggagaaattcaaggcgcatccggcttttttagatgcgtccacccttgccggctcttcctttgcattgtcggcccaaaagcagaatgacacaccgtatattccttttatgattaatcgtttttgcatatatcagccgtttccgaaaacgatttacacttattctgcggaaaacagccgcactgaaagcggcgcatcagatagcgaacctgatttttattcggccgacttcacgatttacgacagggaagggaacgtattggccgaatgtgagaaactgacagtaaaaagggtcagacaagcgaatatgattacccatctgatagacaaagagaagccgcctcagcagaacaaaaacggccgtggagagcccgaaagtcctgtggccgcagaagacgtgtctgaacagcaaacgccggaacaaaacatggtgacttacataaagtcggaaatcgccaggctgatcaatcgtccggcacaggatattgatgtgcggaaaggcttttatgatatggggcttgactcggcgcatttgctgaagcttgtaaagatattagagcagacttttcagcagcagttttatccgacactgctttttgaatattcatctgtccgccgccttgcggattaccttatcaatgaagcgggctgtgtgctgaaagattcggccgaagaacggcatacatcagacgctgacatcgctgatgaggttctgttttttgaacccgcctggaaagatcatccgctggaaacggcggtgcagaacgggcaaaaacacacccgtcatcttattattgctgccgatgcaggaccccgtctcaccggtgaactcggcacacattgcccggaagcggaagtgatagaactgaaaagggagcatgaggttgcagatgagcagtttggagcagatgccgagcttatatttcgtatgcttaaacgggaactgacagaccatccgaaagaacatacattgattcagcttgtatgcgccgttgagaatggagcggcattgtcttccgctctcggggctatgctgaaaacggcacatctggaaaatccggctcttcgcactcaggtgatcaccttctgtgacaagaatgagagattgccaagtgagacggccgcaatcattagaacagaagcagactgctctcatgcaggctgcacagacattcggtataaagacgatatgcggcagatcagattgttcgaacgtattgagaaaccgggcggacagacacagtctccttggaaacaaaacggcgtatatgtcattacaggaggtctcggcggtcttggatttctgcttgcccgtcaccttgcagaaaaagaaaaggtgaagctcgcactcatcgggcgttcgccggaacagtctgagaagatcagcagactgaaagcattgggagcggaagttctttacgttcaagcggacatcggcagcaaagccgaaacagagcgggcatttgctcagattacagaaactttcggccgtctgacgggcatttttcattgcgccggtgttttaaaagatcaatttatcatccaaaaagacagtactgacttgaagagggtgttcctgccgaaaatcagcggcctgattcatgcggacgaagcttcacggcatgaaccgcttgaatttttcgccgcattttcctcattctcggcgttgaccggaaatgcgggccagacagattatgccgcagcgaacgcttttatggatgaatatatgaaatatcgcgattgcaaagcggaaaaaggcgaacggaccggggcttctatgacgatcaactggccgctttgggaagatggcggcatgcaggttgacagtttgatgaaagagatcatgaatgatgcaaccggcaccagcccgcttccggccggggaagggatggcttcactagaatatatgctgcgtctcggcaagctgcaatccgttattttatacgggaaggagcctgctgtaactgaaagcatggcccgattggttccgatggcagacaagaaccgctcttcattatcccatgcagctgtcaagagaaggagccgaaaacaagagagacatacagaagagcacgatattgccgtaatcggattggcgggaagatatccgcaggcgggaagcatcgatgaattttaccaaaatctgcgctcaggtaaagactgtatcacaacaatgccgaaagacagatggaaaggttatcctttctcatatgaagcagatcagttctactgttacggaggatttttagatcgcatagacagctttgatccgctgtttttcaatctgactccgcgccaggctgaaatgatggacccgcaggcgcggctgtttttagagacggcttgggaagcttgtgaagatgccggtttttatcaggacagaacggcgcgcgggccatcttcacaaaaaagaaaacgcgtcggggtattcgcaggtgtgttttggagccattatgagctgttcggcgctgaaatcacacagcggggcacaccgctgtctatgggcgtgacgcctgcctccgttccgaatatcgtgtctcactgcctgaactttacagggccgtcaatggctgttgatacgatgtgctcttcttcgctcacatccatacatttggcatgtgaaagcattaaaaggggggagtgcgaattcgccattgccggcggtgttaatgcggtcacacatccgcataaatatgcgtttttggcgaatgccggatttctgtcttcagaaggcgtctgcaaaagcttcgccgacggcggtgacggctatgtgccgggagaaggcgtcggcgcggtgttgctgacaaccgttcaagaagcggaaaagatgggctgtccgatatatggcgtcataaaaggctccgctttaaaccatgtcggaaaaacatccggtttgaccgtgcctgatccggcatcacaggcggaagtcattacagattcctttcagagtgccggcattgatccggagacattgagctatattgaagctcacggaacgggtacgtctctgggtgatccgattgaaattgaagggctgagccgcgctttccgcaaatggacaaacaaaaagcggttttgcgccatcggctctgccaaatcaaatatcggccatttagaaggagccgccggaatcgccggattaacaaaggtgcttttgcagctgaagcatggagaaatctttccgtcattgcacgcggacacgctgaatccccatattccatttccggatacgccgttttatgtggcggaccggctggaagaatgggaacggccgtcacatcctgaccagccgagaagagcgggtttaagttcttttggcgccagcgggagcaatgcccattttgtcatagaagaatatctgccgccgcaggctgaaaagaaatcgctgagtatacgggaagacgagccggttctgtttctgctttcggcaaaaaatgaagaacggctattggaatatgtcaaacggtatgaccgctttttacgggaaaaagaagtcaatcttaaagacctggcctacacgcttcaagcgggcagagaagcgatgcctgaacggctggcattgatcgttacatccgtttgcggcctgcaagcgaaactgaaggatgtgcttgaacggaaaacggaaattgaagggtgtttccgcggacgtgctcaagatgttatttcaacaagtggaatggccgagcttttgaaaaacaagcaatattccagattgctcacggagtgggcaaaaggagccgccgttgactggagccagttatacgaaggagagaagccgaaacgggtcagccttcctgtatatccgttcgcgaaggagcggtattgggtgcctgtgcctgcggatatccggaaacagacagacgaaccggcggaaaaccaaaagatcattcttcaaaaagactggaagcagcaagatccggcggagtctgaagcattatcaggaacagtaatgatacttgcaactgataagacgagccgattggccgatgctctatttaaaggaaacggccatattgaaacgatctgtttcatccatcaggcaaaagacggcgccgattattacgctgccgcatcggggcgaaacctttacggcagagtgcgggagtctcttcaaaacaaacagatactcggggtcgtcgacataaccgcatatgatgcggaatatgaacggcgggaagagatagaatacggaaagcttgcctttttacagcaggttctggaatcattccgtcatagcggcgctgtgctcagccaagtgacacaccgcctccagcctttcaaggaaagtaaacctctgatgcagggggcgaaaacggcggggctgtaccggatgctgggcgctgagtatgccaacattcattcttttacgatagatagcgattgtgcgattgagcatacagaagaattaagcagacagattgaaactgaatttttacagccgcgggccaaaagcggcagtgaatgctgctacaggctgaatcgccgttatgtgccgtttctgaagccgggtacgaatgtgtctgcggtgcctgagctttcctattcgtctgatgatgtgctgttaataacgggcggatcgcgcgggatcggcgcaattgcggcggagcatgccgtttcacgcgggtgcagaaaactggtcatcatggggcgggagccgcttcccgattcctcggagtgggaagacatgaaaaaggacggcattctcccggaaaaagccgagcggatgcagaggttagccgagcggggcgcggagatccgttattacagcgtttctcttacggatcaaaaggggctccggaacatgacggacagcatccgcggcacaatgggaccgattaccggtgtttttcattgcgcgggtgcaatgggagaacaccccgctttttataacaaaaccgaaactgagatcgaaagcgtttgcacgccgaaagtaacagggcttggcggtctctatgaagccgttcggaatgagccgctgtcgttttttattttgttctcatccgtttcgggtctgatcccttcgcttgctgcggggcaaagtgactacgcgatggctaattcatttatggactcttttgcaaatcatcaggcaggcaaaggaaacgtgtttgttaaagccgttcaatggcccgtctggaaagaaaccggcatggctgaaggcctgccggaaacacctgcttatcaaaaatcaggactttccaggctgtctgccgaagacggactgaagtttttagattacatcatattaaacggacaaagctgcggaattccttgtgttcccgaagacagtaaggctgattttggtgatcttctgaaggtgaagaaaactgaagctcccatgaaaaaaagcagtgccggtgaccaaaaggtgaaggatatgattcgtcaatgggtgcgcaccgttttcagcgaagaactgaaaatgacggatgagcagataaaagatgatatgccgtttgatgaatacgggattgactcaatactctttgcggaattggttcaatcattgcaaaaacggatcagcatcaagttaacaccgtccttaatgcttcaatatcaaacgattacagaaatggttgactatttcgcagcgcatcatgaagccgattttgtgacaaaagaaaatggtttcgttcaagacggggacgttcagcctgatgtaaccgccgccgctgaagagagaacatccatgaagccgaaagcggataccgaagacgatattgccgtcgtcggcatctcctgccgttttccgggggcgggcggaacggatgctttttgggagctgctgatgaaagggaatactgccatccggcctgtccccgcatcgcgctggcatgcaacagcaaatgcaaaggattatgcggggtggattgatgatatcgacatgtttgatgcgggctttttcggcatctctgaaaaagacgcggcaattatggacccgcaggcgcggatcatattagaagaagcggttcattccgtttatgatgccgggtacggccaaaaggatttgtcgggccggaaagtcggcgtgtacatcggcggcagggcgcagccttcagccggtatggaacatatcctgcaggcgcctaacccgattttgggggcggggcaaaactatttggcggccaacatttcacgatttttgaatgtcacagggccgagccttgtcgtggatacagcatgttcctcagggctgatcgggctgtcctttgcaaaagacgcccttttggccggaaggattgacgcggccttagtcggttcggtgagtctgctcttatctccgtccgcgcaccggttattcggagcgcgccatattttaaatgagaacggcgtgtttcatatattcgaccgtgaatcagcgggagaagtgctcggagaaggagcgggggcggtttttatcaagcgattgagcgatgcggtgcgggacggagaccgcatttacggcgtcataaaagccgtctcggtaaacaatgacggccggacgctcggtcccggttcaccgaatataagagcgcagagagatgtcattcaaactgcgcttaatatggcggaaaagtcgcctgaagacatcggatatatagaagtgaacggaggcggttccccaatcgttgattcggtggaaatcaaggcgctctcagatgtctatcagctgaaccggaaaacgcttctgccctgccggatcggatcggtgaaaccgaatgtagggcatttgcttctgtcttcaggtcttgcgggcttcatccgatgtgtgctgagcgtctatcataagcggattccgcctttcttatcagcgcgtgacccatttgaacattatgactttgaagcgtcgcgtattcattttaatcgtgaacccgttgattggcattcagagaagaaaccccgcgtcgcagctcagagttcatttcctgacggcgggacaaatgctcatatcctcgttgaagaatacagaggtgaaagacagcgggaacatcaccggtcgcctcagccgccggaattcagaaaaaaacactacccgctcttgggcggctggaacagcacggaaagtgaaccggaaaaaacaagtaatgaaaaaacggacattgcggatcttttaaagaaatatgagaaaaaagcagagacaagcactgcacctgcagactcgttttggcaggtgacaacgtgacgtttttaaaaggggactaaccatgaaaaaaacagtgaatctgcgcctgacggcagagcatcccattatgaaaaaccatcttgttcacggagaatctgtcatgcccggtctggcctatattgatatgctgtatcagctggcaaagcaaagccttgatctttcattccgttccatctgtctgaaacgggtgaccatttatcatcctttatcagtgaagcggtcagagcggcttgatgtgagtgtcatattcagtaaagaaaaggagttctggactgcctcgatttgcgaggcggattccgggacggttttcttatcagcggagatgcatgaagaagtcttctcatcagacaggcgtcttgacgcaggggagaaaaaacaacaagccgcacttccatcagtctccttgcatgcggtttacgaagccgcgagaagccgcggactgtcgcatgacgggctgatgaagccggagggagagatctatgcttatgaagaggcatgtttccttgatattcggcagtctgattcatgccgggaaaatctccccggcgctctctttcatcccgcgctgatggacggtgccgccatggcctccggcgtattgcagacagctgcaggcgccgagttatttttaccgatttattatgagtcgtttattgccgctgagactgttacggagcgctgttacgcggtgatttcgaaaaagtccggcacgccttctgaaatggtgaaaatggatattgacttttacaacctcagcggtgcgcatattgcttcactgctcggcctgacagccaaaaaggtgcggtttgaccggcagctgataccaggcgttcagcagatggaggaaaccttataccgcattttctcgacatacgtaggccgttcagtcacaagaaatgatgcgcacaccgtgttttttgaattaggtcttgaatcgtcacagcttctggctattattaaagacatcgaaggggcgtttgatctgcgtctgaatccgactcttttatttgagtgcagcagcatatccgaactgctcgaagacataaaaacaaaaggaacagatgaatcttccagccttgtcgcagatgcagcaccggtctctgaaacacaatcaggcagtcagacatttactttctatgaacatgaagcattccttcaggatcatctggttttcggcaaaccggcactgatgggtgtagtgtatccgtgtctggtgcttgaagcatccggagcgtctcattccggcacgtgtcccgccgagctgaaagatatccgctttacgggcgggcccgtcacgctggagcctggagaggccgcgcagattgacatttcatttgcggcagaaaagagtgccgaacgctttacagcaagctgcactgtctccggtaaagaaagccggaagacatgtgcggaaggagaaataagcagatatacagaggcacccataaaaaaatcatatgacgttgagcaaatgaagtcgcatgcacaaaaggtggcgccggatgtcatttcccgtctgtacgattcggttgccgacttcacgataggcccgatgctgaaaacggtaacagcgggatacaaaatgagtgagagctcctttttattgcagctggacttatcaggaaaaaaagaaaaaggcgatctgcatcactttgcatttgacccgcttatattgaattcatgttatatgtcgctcggtgaagaagaattgcagctgaaaaagcggattcacgtcccgctcatgattgagaggctgacgctttacggacctgtcatgtctgataccgtctatgtggtgaatacaatcaaacataaaaaagacgggtttctctcatttgatgccgcaatcctcagtcataccggggaacagctggcggaattgaaaaatgcgtctgtgaaagaagtgcttcagccaaatcggcttgaaaatgcgtcttttgccccgtccgggaatcaaagccgtcaggaaacgaaaggaaaaccgctggatattgccattgtcgggatttccggcaagtatccgcaggccgatgatatcgatgcgttttgggataatctcaaacaaggcaaggattgtattaccgaaattccgaaagatcgctggaaatgggaacattacttttccgaggaccgtacggcgccgggagcgatctacagcaaatggggcgggttcattgacgggatcgccgattttgatcctgagttttttaagatttccccccgggaagcggaacaccttgatccccaggagcggctgtttttaatgcatgcttggatggccatggaggatgcgggatatacgaggacatcacctgaactggggcgtcaggtaggcgtgtatgccggtgtcatgtatcaggaatacccgctattcgcggctgaagcgggagtgaaaggacggcatatcgggctccccggcgggatttcatccattgctaaccgtgtctcctatttttgtgactttcaagggccgagcatttcggtcgatacgatgtgttcgggttcgctgacttcattgtacatggcgtgccgggatctgcgggatcatcggattcgcgcggcgcttgccggcggagtgaatctcaccgttcatcctaacaagtacttcatgctgagccaggggcagttcatctcatctaaaggacactgcgggagtttcggcgccggaggtgacggctatattccggcagaaggggtcggggtgctgcttcttaaacgtttagaagacgccgtacaagacggagatcggatttacggcgtcattaaaggagctgccattaatcacggcgggagagcgagcggttacaccgtcccgaaccccaaggcgcaaagcgaagtcatttctcaagctttacaggaagcgggggtatctccgggccggatcagctatgtggaagcgcacgggacagggacgaaattaggcgatccgattgaaatccgggctttaaccgatgcattcggtgatgttcctgaaacatgtcttgtcgggtctgtcaaatcaaatatcggacatggggaatcggcagcaggcatcgccgcagttacaaaagtgctgctgcagatgaagcacaaacaaatcgccccatccttgcatgctgatgttttaaatccgaatattcaatttgatgaagggccgttttccgtctgccgtgaattaacagattggaaacggatttcagcagacggagaagaacagccgctcagggcgggaatcagcagctttggtgcgggcggttctaacgcgcatatcattattgaagaatatgaggctcctgtcaaacaagcaatcagcagccaagagccggcggtcattctgctgtctgcgaaaaatggcgagcgtctgacagaatatgcggagcgccttcttgcttttcttcaaaagaagcatattgataagccggacttatttgatgtcgcgtacactttacaagcggggcgcgaagcgatggatgagcggctggctctcattgcggactcccttaaggagctggaggacaagctcagatcgtacttggaaaatgaaaacgcaccgcatctttacaggggacgggcgaagcgaaatcatgagacagtggctgtgtttgaatctgatgaagatttgcaggaagcgatggttaaatggctgaaaaagagaaagtacggtcatttgctgaaaatgtgggtgcagggagtcgatgtggactggaacttgttatattcggaacaaaaaccccggagaatcagtcttcccgtctatccgtttgcaaaagtcagatgctggattcaagatgaagccgaggcggtttcaaaaagggatgacggcaaaacggtgatccatccgctgctccatgaaaacacatccgatctttgggagctgaaattcacctctgtttttaccggacgggaattctttttcactgatcacacagttaatggacagaaggtgctcccgggagccgccgtgatcgaaatggccagagcggccgttgagcgtgccgcatacgctgtgccggacggacgtaaaggaatgtatttgaaagatctcatatggatgaggcctgtcattcataaagggacggatgtagaagtccatatcagccttattcttaaggaaaatgaagacattgaatttacgatttacagcctatcggaagaacctgggggagaacggattttatacagtaaaggcactgcggtatcgggagagatagcagcggttccgtctgttcatttagagggctggctgtccggctgcagtcaatcggttatgacgtctgatgaggtttatcaggctttccggcatgcgggtatgatctacgggccgagccatcaaggcattgatcagctgatgatcggagagaggggggctgcagcccggctgtcgctgccggaaacggcagacagtaccgccgatcagtttgtcatccatccgagtcttctggatgccgcgtttcaggcgtcactgggggccggttcagatactgccggagacactccgatgctgccgttttccctgcggcaggcagaaatatttcagccgactcagaaaacgatgtgggcgcttgtccgcaaacagagcgatcggtcagataacggagcgctgacgctggatattgatttatgtgatgaaaacggcgctgtttgtatgagattgacgggcttctcctgccgggctgtccggcagacaaaccaaaccgaaagcaaacggcaggaagttcagacggcgatgcttgcccctgtttgggacaaaactttcttttccctggaagaaaatcgagcggttgatcaggaacaattgctgatcatcggaaagccgggaaataccataaaggccgcggcaaaaatgtggccccgcgcccatctggcggagacgccggatcattcaagcgagcaaacattacgtgaattgacagccggttatcaagatatccgccatttcttatggattgcgccggatcgtttcgcacccgcatccgccagtcaggaaatgcttgatgagcaggagaatggggtgattcaatgtttccgtttcatcaaagcgctgctgtcactcgggtatggaaaccgaaacatcagctttacggcggtcacccggcagacacagtccgtgtatccgggtgatctcccgcagcctgagcatgcaggcgtacacggtttgatcggttcattggcaaaagaatatccgaactgggacatcaggctgattgatgcagaagaaggcagtgattcgtctgagatgaaaaacatctggcgccttcctccagatccggacggaaatgctgccgcgtaccgtaacggagcttggcacaagcaaaaaacagtccgggtgctgacaagttccgctccgcgtatgtcgtacagagaaggcggcgtttatgctgtcatcggcggagcgggcggcatcggagaagcatggagcaaatacatgatcacccgttacaaagcacggatgatatggatcggcaggcggccgaaggatcaggagattcagagcaaaatagacaggctggccctatcaggccccgcgccgcattatatacaggctgatgctcaagatgccgcagcgcttaaagcggccgtccgttccataagagagcgatacggcaatataacgggagtcatccattccgcgataacgcttgccgacaaaagtatggcgaatatggatgaagcttctttcagaaacgctttttcagctaaggtgaatacgagcgtccgaatgatcgaagcttttaagggagaaccgcttgattttgtgctgtttttctcatccgttaattctttcacaaaaaatgccgggcaaagcaactatgcggcagggtgtacatttcaagacgcctttgcccgccatatcgcttccttgcttgattgtgaagtgaaagtcatgaattggggatattggggcagtctgggcgttgtatcagacccgtcttacagaaaacggatggaggcgtcagggatcggttctattgaacccgatgaagcaatggaggcgctggaagtcttactatcagaaccgttcagccaagcggcattcatcaaagctgctccgcacggcttagccgcactgacggatcaagatgcaatatcggttgtatccggcccggagccttcatttatggaaagcgtcaagcggcaaaatccggatcggaatgaacggcttgagactttaaaacgagaaatggagttgcgcatatgaacagccttctttgcaaactgctcttttatcaattacagtcaatcgggtttttcagcgagcctgtcaccacacctgcagcatccatgcggagcgccggcgtgatcggcacatacggcagatggctggaagaaagcctgaatctattaaaagaaaacggatatatcgcgtatgacggatacacgatcactcttctcgcggatcagcgcccggacggccgcacagtctggaatgagtggaatgcccataaacgcctgcttcccaagggggagcttgcgcaagctgaattggccgaggcgacgataaaagcgatgccttcaattttaaaaggagaacgtccggctacggatatcgtatttcccgattcatcaatgcggctcgttgaaggtgtttataagcataatcccgttgcggattattttaatgaagtgttagcagattccgcggccgcttacctgaaagcctaccttacagaacatcccgatgcccgtatcaggctgatagaagtaggggccgggacgggcggaacgagcgccatgctgtttacaaaactgaaaccatttgcaaaacagattgcggaatattgttatacggatgtttctaaagcttttttaatgcatgccgaacaggaatacggacctgatgtgccgtatttgacaacagccttgtttaatgcggaggagccttgcgaatcacaaaatatcaaaacgggtgtttacgatattgtcatcgccgccaatgtgcttcacgccacaaaaaatatcggtttgacactgcgccgtctgaaagcgctcctgaaatacaacgggatgattttgataaacgaaatcagcgatcgttctgtttttacccatttaaccttcgggctgcttgacggctggtggtcctatgaggatgctgagcttcggattccgggaagtcccggcctatatccaaaatcgtgggagcgtgtgctgcattcggaaggatacagagcggtttgtttccctgctgaaacggctcatgatttaggtcagcagattatcgcagctgagagtgacggactcgtccggatgcaagggatcagagacggcagaaagccatacgccgccccggccgaagttttccgaaagcccgcacagcctgtttcccgcagccgcgcgccagaggagcatcaagctgttaaggctgatggggaatcggtcgcttcccatgtccgctctgtcatcaaaacaagtattgccgatgtattaaaaatgaaagaagaggatattcaggaagaactgaatttctctgaatacggtattgattccattttggccgtcaatgtgattaacgagattaataagcgattgaatcttacactgcagacaacgattttatttgattactatcatgtgaaactgctgaccggttatatctcggcagaatatgaaaccatcatagcctcatctctggagaccgaaagagcgaaaatccgcccggtgcttcaggaagaacggcctgctgaaaaacctttgaagacggatagaaaggaaaacggttatcagaaaccgaaacaagaacggatgccgctttctttcgcaaagtccgatgactcgggaatgttccgggttgtgattgaccgtccgggcggcattgaagatctgacgattgcccgcagtgaagtgcccgagacaaaagatgacgaagttcaaatagccgtccgcgccttttctttgaacttcggagacttgctttgtgtcagagggctgtatccgacgatgccgccttatccgttcactccgggattcgaagcaagcggcgtcgtgatcaagacagggaggcatgtaacatccgtcattccgggtgatgaagtgattgtcggtatgggagaggaatttggctctcaggcgaatctcatcacatgtaaagaacatcaagtctatcataaaccggcccggctgacctttgaagaagcatgcgctcttcctaccgtggcagtgacaatgatagacgccttccggaaagccggacttaaaaaaggcgaaaaaatattaattcagaccgcgacgggaggaacggggctgatcgcggtgcaaatggcccggcatatcggcgcggaaatatatgcaacggccggatcacagaaaaaaattgagtatctgcattcgctcgggatcaacaataccatttgctatttggaagaagattttgaaacggaaatcatgcgaatgaccggcggccgtggggtggatgttgtcattaataccctggccggtgatgccatgcaaaaaggaatgaattgcctggcgccgggcggaagatatatcgaaattgccatgactgcgctgaaatccgctaaatcagtcgacttgtccgtccttcataacaatcaatcgtttcacagcgtggatttgcggaagctgtctcttcaaaatccggatcaggtcaaggactatcaattggaactgcagcggctggcggaagagggagtcattcagcctgtcatctcaaaaatcttttcctttgaagacataaaagaagcgtatcactgtctggatgaccgcggaaatatcgggaaaatcgtcatcagcgtttctgagccgtatcaaatgacgtaccgccccgaacaaaaggatccggccgaaacggtaaaatcagcagctgtgttacctgaaaaagaaccgatcgcgattatcgggatgagcgggcggtttgctgaatcggagaatgtccatgagttttgggaaaacttagccgccggacgggatctgattaaaaaagcagacagatgggctgtctctgacagtcaatgccagtatggcagttttatagagggcattgaatgttttgatcccgttttctttcatatatcgggacgtgaagcaacctatatggacccgcagcagaggctgtttctggaagaatcatggaaagcgcttgaagatgcgggatatgcgggagactcggtaagaggccgggaatgcggcgtgtatgccggctcctgcggcggagattaccaggccatttttaaacagcaggggcccgcgcaggctttttggggcaatcacaattccgtcactccggcaaggatcgcctatcaccttaatttacaagggccggcgatcactgttgatacagcatgttccagttcgctgacagccattcatttggcatgtcaggggctctggacgaaagaaaccgaaatggcggtggcgggcggggttttcattcaatccactcccgctttttatcagtcgtcaaataaggcgaatatgctgtcaccgaccgggcgctgccatacgtttgatcaaagcgcggacggcttcgtgccgggtgaaggcgtgggagcggtggtgctgaaacgtcttagcgacgccgtcagtgacggagatcatgtgtacggcgtcataaaaggctctgcaatgaatcaggacggcgctacaaacggaataaccgctccaagcgcgctttctcaagaacgattggaacggcatgtctatgatacttttcacattaatccggaaaccattcaaatggtggaagctcacggaacgggcactgcactgggcgacccgatcgaattcagcgccttaacgcgcgctttccgccgctatacggataaaaaaggatattgcgccatcggctctgtgaaaaccaatctcggacatgccgctgcggccgcggggatggccggattgtttaaaatcctgctgtcgctgaagcatcggcagattccggcttccctgcattttcatcaagccaatcagcatattcaatttgcggacagcccgttttttgtgaatgaaaagctgataccgtgggaacggaatccggatgcaccgcgcagagccgcgatcagttcattcggattcagcggaacaaatgcccatcttgttattgaagaggcgccgcaaaccgtgcgccggtcaccggcaaaaccggcctgcctcattcctttatctgcgcggacggagcgtcagctggaaattcaggcagaacgcctgctggattcactcagcaagaacaaagacagcgatctgggaaatataagttatacgctcctgctcggcagaaagcatctgcatcaccggtttgcctgtatcgtaagcagtgcggacgaactgaagcgggtattatcggagtggcttgtaaaaagagagcttccgggtgtgtttgtgtccaatttgaaggaccagaagccggcagacgaagccggaatgaaaacattcggaatggaatgcattgaacagtgctgctcggcggcttcacccgcacagtacagagaaagcctggcacatatcgctgaccttttttgcagaggatatgatcttcctttcacacggctttttgacggagggcaatattataaaacgccgcttcctgcctatccgtttttaaaagaaaggtattgggcggctgatgtaaacagttctttaccaggccaagccatgaaaaagtctgaaacgcaaaccgttcccccgtctccgccacagcctgaacatgaaggtctgatttctctgagtcctttaactgagatcgaaatgacagcgtttgaaccggagacattgcaaaaaccgatcgtcttacagcctttggattgtactgttcctgtccagcagccggaaaacgccgtttccgaagacaatagaacattgcttgaagaattgaggataagcctggcagatattttatttttgtcgccggaagatattgatgctgatgagcctttcatcgacatggggcttgactccattatcggggttgaatggatacaaacagtaaataaaacgtaccacactgagattactgccaataaggtgtatgaacacccgacgcttgaggagcttgcggaatatatagcggggcaaataaagaaacccgagtatgctgaagcggaggaaacagcggtacgtccgcaaatcccggaagcagaaactccccttgccggcatctctgacggcactttgcgcaaagagcttaaagaaagccttgcggacatcctgtttctgaagccggaagatattgatgagcatgaggcattcattgacatggggctggattctattatcggtgtggaatgggttcagtctattaataaaacgtatcaagcgtctattacggcaaatctggtctatgaatatccgacaatcgcaaaattagccgggtatctgaccggttccgttcaaaaagacactgatgaagtacatgaggaacatacgaaacaaaacgatatatcagaagagacagatgatcaagaaccgcccgaactgatctgtcttaacccggggggaaagggaagaccgattttctggtttcattccgcgctgggggcagtggagctgtaccagcctgttgccgaacggaccgggcgtcctttttacggaattcaggcaagaggatggatgacagaccgggaaccgatccgcggcattaaaaacatggcggaatattacgttaagctcatacgtaccgtgcagccccggggtccttacgatgtaggcggctattcattagggggcatgctcgcttatgaagtcacccggcaattgcagctggctggagaaaccgttgagtcaatcgtcatgctcgactcctttgactcggcgggtgcgcgggaaataaacattcctgatgaattatttgataaaaatatgatgctgcagacggtgaacatggctttatttgcaccgatctatcaacatccggaacgcatttctgaaaccttgattcaccgtgatgaactagatgccgatcttcatgaagacatatttttagagcaattaatagcaaaagccaaacagcgggggttaacgaagacggacgcgttggtgaaaaatctgatcaggcagaatataaacgttcaggacgcttacgaaatcactgattacgaactcctgccgcttccggatccgaacggggtgacatgctattatttccgaaataaaaacggtattttcttgggtgagcttgatccgtattttacgatcagggccgatattttatccgctgatttcgtcaactactggagccagtggcaagagcatatgacaaacatcgccatcatggatgtggcggtatccaaccatatgacgttattggctgaagacagcgcagccgaaacgatttctgaattttgcggcgttttatattcggcagacggaatgacagaacacagctttctgaaactgcaggaaaagatactgaacgtgcatggtgagatgctgaagcagcccgccaaaataagaccgtaaattcacatatccgcccgccgggtttactcgtaagctttggcgggtcatttcaaatcttggacacatcttggaggaatgaaaatgaccagtttaacaaaaatcagacagcagcagccgtacaagtggtaccaaacgatgagagaaacctctcccgttcattacaatgaaaaggaagattgctgggaaatcttcacctatgatgaagtgaagcgggtgatttctgactacagtcatttttcttccgatcataaatacttaagtgcggacaagcaggaaaaaatgatccggcatattaacaaagacagccttttgaaaatggacccgcctgaacacaccgtcttcagaaaattggtcaatcagccgttcatgccgaaatcggttgagtctcttgcaccgcgtatagccgctatcgctgatgacctgcttcaggccgtccgttcaaaaggcaggatggacattattgaagattacgcatttccgcttccgattatcgtgatcgcagagcttttaggatttcctccgaaagacagggatatctttaaaagctgggtcgaccaaagccagaatgtaaaagatgaaaagaaaatgaatgaagtgcaaaagcagatgatcggatactttatgcagtttattttacagcggagaaaacagccgcaaaatgatttaatcagccatttaatttcagctgatttagacggagagccgctgtcagacaagcaattaatcggtttttgcggcttgttgatcgtcgcggggcacgtaacgacggaaaatgtgatcggaaattcatttctcagtctcaaggagttcccgcatattctgccccggctgcttgaaaataaggcgctccttcctgactttattgaggaagtcatccgcctcagaccttccattcagcgggtaacccgctacaccgcggttgagagcgagattggcggaaaaacgattccggccggagaaaaagtatatgcgtggattggatcggcgaacagagatgaaaagaagtttgaaaatgccgatcagattgacttgggacgaaagccgaatcagcacctgtcattcggtcagggcagccattattgcttaggagcgccgctggcccggcttgaagcgaaaatcgcgctttcccacttttttgaacagatgcccgcatggcgttttactgaggatcaagagccgaatctggttccgagccctgtatttcacggcgttgacaggctgcttgttgagttttgaacgaaaaaataaaagaggcttcgcgggaagcctctttactctgggggcttggagaaatgaatgtaggaatcgaagcaatgaacgtgtttggcggaaccgcgtatgtagacgtcatggagcttgcggaacatcggaacctggataaaaaaaggtttgagaacctgctgatgaaagaaaaagtggtggcgcttccgtttgaagatccgattacgttcgccgtaaatgccgcaaaaccgattatcgattctctgtcagaagaggaacggaatcagattgaaatggtcattacctgtacggaatccgggattgattttggcaaatccatcagtacatatgtccatgattatttgcagctgaagcggaattgccggttatttgaggtgaagcaggcttgctattctttaacggccgggtttcaaatgggcgtgaatttcatcttgtcgcaaacatcgccgggagcgaaagcgctcatcatcggaacggatatttcccgctttttagtggctgaaggcggtgacgcgttgacggaggaatggtcctatgccgaaccgagtgcgggggcgggagctgtcgcgcttttagtcagcagcactcctcatgtctttttgcttgatcaaggtgcaagcgggtattacgggtatgaagtcatggatacctgccgcccgattccggatagtgaagcgggggatgctgatctgtcgctcatgtcttatttggattgctgtgaaaattcatttcaggaataccgaaagcgtgtgagcggggcggattataagaatacatttcaatacctttcttttcatactccgtttggcggaatggtaaaaggagcgcatcggacgatgatgagaaaattggcaaaggctaagccgcaggacattgaagcggattttcagcaacgcgtgctgcctgggattcaatactgtcagcgcgtcggcaacatcatgggggccaccgtatttttatctcttgccagcacgattgataacggctcttttgaaacgccgaaacgcgtcggctgtttttcatacggttcgggctgctgctctgaattttacagcggtgtcgttatgccgcaaagccgtgcgcggcagaatcaatttcagatcagccggcatttggatggacgcgtccgtttatcgatgactgattatgaccggctgctccaagacagcggcatcgtaaaattcggcacaagaaatgccgcgcccgcagcagacatcccgaatgcgcatcaaggaaaaacgcgattagtgctgactgaaataaaagagtttcacagaaagtatgaatggacgacctagtataagagccggaaaggcttgagtatttttaaagaaacggagaatacacatgaatccaatgattgatgtacaggaaacagaaccgggcattgtgcaggtcacaatgcaggatacggccgggaaaaacgggctgtcagaagagtttgtaagagagctgcaccgggtattccaagacatcaatgcccatccgtcctataaaactgtccttctgacgggttacggaaattatttctgcacgggaggaacgcaggaggggcttttgaccattcagagcggaaagcttcaatttacagatttaaagcttcacagtcttttattggattgcaggatccctgtgatttccgtcatgcaggggcatgccatcggagctggctttacgatcggtctgagctcggatttcgtcattttaagcagagagagtttttattcttgtaattatatgaagtacggatttacaccgggaatgggcgcgacgtatattgtgcctgaaaaactgggaattgtcctcggggaagaaatgctgtttacggccgcgaatttcagcggcgccgctctggaaaaacggggtgttccgtttgaagtgctgccgaaaaaagacgcccttcaaagaggccgcgaattggcccggctgctggcggataaaccgagagcctcactggttgcgctgaaaaccaatgtgaccgcacggatcaaaagagagctgacaaaagcggttgaggaagaggtaaacatgcacgaagccacattccatcttcctgaagtaaaagagagaatcagccgcttatacggcagttaaacagaatgaaaaaagcatgggatgcccccatgctttatgactggtccgtcttttgcagaacggagcctgcgaattgttctttaatttcggcgctccgggctgcggtttctgcgatgcagtgcatgatggcttcttcaaagcggcgctcgtctaatgcgcgaaggcctgcttcagtcgtgccgcccgggcttgtgatttccttacgcaggcgttcaggccgtttgctgcttgttctgagcatttccgtcgccccggccatggtttgtaaaatcagctcttttgccgtttcttccggcaggccggcttgaagggcggccttttccatcgcttccacataccggtacacataggcgggaccgcttccggcaatggctgtgacggcatcaaggtgtttttcttcaaagagcgtcgcttctccgattgtttccagaagctcttttgccgtccggatttcagcttcactcgcctcggagcttgcggaaaaaccggtcgccgattgctgaatggccgcggatgtattcggcatcgcccggatgatggtgagctttctgccgaaatattgctgaatcgtgtgaatcgtcagccccgcgatgacagaaatcacaagctgatctttcacgtattcgcgaatgttctcaatgctttctgccgcatctttcggtttaaaggcgagaacaataatgtcggtattgctgaaaaactcttctttatcccggcacggtttcactccgtacgttttttggagctcttcaagccggctgtcatttgaccggtttgtcatatatatatgtccgggggctgtcattccgctttgcagcagtccgttcaccattgcttccgccattgatccggccccgataaaaccgattttcttcatataaatcctccttcttctaaaacacaaaaaaaccttcccgtcaaaaaggacgaaaaggtttcgcggtaccaccttacattagcacgaatcagccgtgctcagctcaaatcccgtaacgagggatacgtttaggttttcctaaccgctctgagggcaggttctgtaaacaagagggccgcaatgtctttcagccggggacattgctctctgctgccgttgtttatatactagttcctcgtcatcgcgttccgtgttttctagtttgttgttcattatgctatgcgaaagagcgggatgtcaatctttttttccgatatgcgcaataatgacacagtgaaaagaaaacgctaaaatatgattattcaggaatgaaaagaacgaaggagcgtaaacatggcagcgagaaagatcattccgatacgtgtgccgactccgtttgcagtcggcgacgttatcgtttatttaataaaagatgaagccttaacccttattgactgcggcccgaatacaaaggaagcggctgaatcgctctcatttcagcttaaggaacacggcgtttctgcggcggatatagaacaggtggtgctcactcatcatcacgcagatcattcaggtctgctgcaccttttttccgaggatacggaagtgatcgggcatccgctgaatgacaggtacattactcaggatcagtcgtatatcgcccggcaggaggacttttttctgtcgcttatgactgaaatgggcgttcccctgacgcctgaagacatacagaaaacagttaagctgtcgtacttattttctgcaaaccgtctgttaacgaaaacagtggaagaaggcgggaaaatcgacgggcttaacggctggacggtgctcgaaatcccgggtcatgccgcttctcacattgcgctctaccatgaaaaaagcggtgaaatgttcagcggcgatctgcttttgtccaacagctccaccaatccgattctggaagctccggaaaaggggggcgtgcgcgcggccccgatgctcgactacttgaactcaatgaagcggctgtatgacgtaaacccgtcccttttatatccgggacacggcgatctgctgacggacgtaaagcctgcttttgacaggcggcttgaaaaacagagaaaccggtcggaatatgtgctgcgcctgttgtcagaggaaacgctgacggctttccaggtatgccggcggctgtttccggctgtgtatgaaaatgaattgtttttaatgatgtcagaaacgatcggccatcttgacgtactggctgcaaaaggggaggctgaatcctttcagtcgggaaatactctgatgtttaaagctgtgaaggggtgaaggaaatgggcagattaacggataagcggatttggatcaccggagcatccggcggactcggagaacggcttgcatattcctgcgcggcagaaggggctcatgtttttttatccgccaggcgggaggaccgcttgcaggaagtgaaaaaaacgattaccgcgcgcggcggacagtgtgatgtcattccgtttgacgtccggcatgcagaagaggctgaaaacgtaaggcgtttgatcggtcatgttgacgtattaatcaacaacgccggcttcggtatttttgaaacagccgctgattcatctttggaggatatgaaggcaatgtttgaagtgaacgtcttcggattaatcgcctgtacgaaggcctgtcttccggtgatgcttcatgcgaaaagcggccatattatcaatatcgcctcacaggccggcaaattggcgacgccgaaatcaagcctttattccgctacgaaacacgccgttttagggtattccaatgcgctgcggcttgagctggccggtacgggtgtagccgtgacaacggttaatcccggtccgatcaaaacagacttctttacaattgcagataaagagggcggttatgtgaaaagcgtcggcagatggatgcttgatgccgaccatgtggcagagcgtattacatccgtaattctgacggataaacgggaaatgaatcttccgcgatggatgagcctcgggacgaagctgtatcagcttttcccttcgtttacagaaaaactggccggccgcgcattaaagaaaaagtaacaagggggagaaaggaatgtccgacctggatatacacaaggcattgatgacagagcctttagtcaggcaaatggcagaggcgcgtgaagtattttggatcaacccgcataaaaccgatgatccagtaaagaatggcgctgaatggagaaaggagattgccgaagcggaagaaaggctgcgccggtttgcgccttatatcgcgtcggcttttccggagacggaagcggcgggaggcctcattgagtctccgcttgtcttcatcaatgaaatgaaaaagcgtctggaacaaagcgccgctcaggctttccccgggcgtctgcttttgaaatgcgacaatgaacttccgatttccggttctattaaagcgcgcggcgggatttatgaagtgctgaagcatgctgaagatctcgctttaaaagcgggaatgctctcaacagacgatgattacagcatattgactgaggaacggtttaccgcttttttctcaaaatactctatagccgtcggttctacgggcaatttaggtctgagtatcggcataatcggcgcgaagctcggcttttgtgtgaccgttcatatgtccagtgacgcaaagcagtggaaaaaggagctgctccgggaaaagggggttcgcgtcatcgaatatgaagcagactacagtctggctgtcaaagaggggcgcatgcaggcgaagcaggacccttattgttattttattgatgatgagcattcccgggatctgtttctggggtatgccgttgcgggaagccgtgtgaaaaagcagctcgatcaaatgaacataaagccgggtgcagatgaaccgcttttcgtttatttgccgtgcggggtcggaggaggcccgggcggcgtcgcgcttgcgctaaagctgatctatggcgggcatgtccatatttttttcggtgagccgacgcattcaccctgtatgctgttaggactgttttccggcttgcatgacggaatcagcgtgcaggatatcggccttgataatcaaacagccgccgacggacttgcggtaggaaggccgtccggactggccggccctctgatggagcctgtactcagcggctgttataccgctgatgacggcacgcttttttcactgctttatcaattaagagcggccgagaataagagccttgaaccctctgcactcgccggtatggccggagccgtcaagttcgttcagaccgaagccggtaaccgttatataaaagagcgggggcttgagatggaaaatgccgtgcaccttgtgtggggtaccggcggaagcatggttcccaaggaggaaatggaagagtacagccggatcggttcctcatttgtgaaaaaaatgggcagacagtgaggcggttttccgttacaatctttgtaagcgtttgttttttaatcggaaagccatacagagagattggtgtgaattgtgaaaagtaaagaattgaacttacatacattgtatacgcagcacagccgcgagtcgtgggccggattcggcggccatctttccattgccgtttcggaggaagaagccaaggccgtagaggggctgaatgactacctgtcggtggaagaagtagaaacgatttatattccgcttgtgcgactgctccatcttcatgtcacgtctgccgcaagacggaatcagcatgtcaacgtgtttctgaaacatccgcattcagcgaaaatcccgtttatcatcggaatcgcgggcagcgtcgccgtcggcaaaagcacgacggcgagaattttgcaaaagcttctttcccgtctgccggacaggccgaaggtgagcctggtgacaaccgacggtttcttgtatccgacggcggaattaaaaaagaaaaaccttctgtccagaaagggatttccggaaagttacgacgtgaaagcgctgcttgagtttctgaacgatataaagtcagggaaagagagagtggaggcgcccgtatactcccaccttacctatgacagggaagagggtgccgtcgaggttgtcgaaggtgcggatatcgttattatcgaaggaatcaatgtcctgcagtcgccgaccttagaggacgacagggaagatccgcggatttttgtatcggatttctttgatttttcgatctatgtggatgccgaagaaagccggattttcacgtggtatttggagcgtttccgcctcttaagagaaaccgcttttcaagatccggcttcttattttcataaatttaaggatttgtctgatgcagaagcggataccatggccgcctccatctgggagagcgtcaaccgtccgaatctgtatgaaaatatcctgccgacaaaattcagatcggatttgattttgaggaaaggtgacggccataaagttgaagaggtgctggtaaggcgggtgtgatgtgaggaggaagcgaatattatgatgcatcatattgaattgtatgtatctgacttgaaagcctccgcccggttttggggatggtttttaggtgagctcggttatagggagtttcaaaattgggactccggcatcagctggaaaaacgccggattttatgttgtgcttgtacagacagaggagcgttttttaacaccggagtaccacagatgccgggtcgggctgaaccatctggcttttcatgctgcgtcaagagagcaggttgacgggatgacggaaaagctgcttgccagaggatgccccgtgctttacagggaccgccatccatatgcaggcggaagcacgcattacgccgtatacacggaggacccggatcggataaaggtggagctggctgcgcctgcttctgaatgaactataacttctcgtttttttcttcgcgcagcgcgtcgagtttcttttcgattctgtccaattgtatgcggcgctgcttcaagcttctgaatacgtatatcacggcaaacaggaaaaatgcggctgcaataaatgagatcaattgaaaaatgacatcaccgatgttcatcttttttacctccgtgtgcggcgggcttcttcagcccgccgttttttcattttaaccgatgtgaagacatgggggatgaatcatttctctcctagctttgtttctttctgagaatgaatagtttctgcatatggcttatgatcacttttgcggccgcatatcccggaatggccagcagcatcccggcaattcctgagaatttgccggcggcaagcagaagaaaaataatggtcagcgggtgaatgtccagcttccgtcccataatttgcggggaaatcagctggctttcaagctgctggacaatgacgacgaccgtaatcaccagcaccgcctcggtcggtgaatcgaacaatccgacaatgactccgggaaatgtgccgatccaaggcccgataaacggaatcagatttgtcaccatggcgaacgcgcccagaacgagcggataatcgagcccgatgataaaatagccgattgtgacgagaacgccgacacagaaactgacgagcagctgtccttgtatgtatgaactgagagcttcatccatatcccgcaggatttgttttccttctttttgatgtttttccggaagaagccgcagcagtcgccggggggctttatttccttcttttaacatgtaatacagcgcaaacggaataatggctgcggtgatggcggcattggcagccgtaccggccagactgctgagagaatcagcgattgaaccggaataatttgcggctttgtccgctaattttttaaaggaatccccatgctgaagcctggaaaaccatttgctgtcctgaagatgcccgatccaattttcagcttttgcggaaagctccggaatatggtctgtgaaggctgtaaactgtttttgaacggcagggcccgccgtataaaggaagaggacaaaaaggccggctgttcccgcataaatcgctaaaatcgcgattccttggggcagctttaatttcgcatgcagcactctgacgagcgggcggcacaaatagtaaaggacacccgataatacaatgggcggaaacaaggttttaaccgtaatcacaacaggctggaacaaaaagtctattaatgttccgagataaatgatgagaaataacagaagaacggcatagccgatcttgaaataaggcccgacaggcatatcctgcaccacgcaatctttagggtttactctcggacgtttcccttttcgcccggtgcataaacgtccgtgtcaggaaaactgcccctgattggtgacgtaatcgtagataatatcttctacatgggcatggagatcctcatcgggttcttcattccttctttcttctaaagctttttttaaactctgtttttcataggggctcagcggatctgtcgacacattccgtccatactggcggagggcttgtcccagcattttttctataaattgatccatcatatattctcctattcttgtcattcatctttattctactaaatatcatgtgatcctcccactcttctatcatattttctgtcaggacgatttaggcttttattccagttcagccgagagaataagatgaaacggcagcgttaacgcatcttcatcgtttatgatttttaaacgtttttcgtcatgcctcacttgtttcacccatccccaaaagcggcgggggccgcgtgctgaagcataggtgaccgagatggctctgtcttcttcaatcgacgccgcaatgatgcggttcatgtcgttcagttgctctgcgctcagttccggaggccggaattcccgttcttttcgtttttttgcaagcagctgctcccgatgttcgggcagcatcatccggcttgattcccacatgacattatacccgggtgttaatttgttcggattcatgtatatcacctcaattatttgtaatgcccgccgattttttcagcccggtgaaaggcttggccggcctctgtcagcgaagcggcatggaggagcgacgcagggccgtaccgctcatgaatatcatccaatactttgccgagactgatctttttttcctgagcatcaaacaggctcagctgaacataatcacagggctccagctgggaaagggagacgccggcgctgcggacgggctcaccgttccaatgctctttgaagagcttgaccgccgctttaaaaatatccattccgaaattagtcggagagaccagctttctctgtctgtgaaaacctgaagggaattcaaaatcagcgcctctgatgctgaccgaaaccgtatggccgatgtattgtttgaaacgggcgcggcgggccacttcttcgcttaactccaacagcacgactttgatatcctcaaagcggctgtagtctctcgggagggtcatgttatggccgatcgctttttgccggctgtgcgtgttgacggtgaccggagagggatcgatgccgcgggctgtccgctgaagcaattcgccgttaatgccccagcgttttttcagcagttcggcggggtgcccggcaagcccgccgattgtgctgatgcccatccgtcttaaatgatgctccatccgttttccgatgccgaataattttccgaccggcagcggccacagatcctccctgatatttgacatatccaatctgtggatgccggatgcgttttttttggcaaaatggtcgcaagccattttcgcgagcgccttattcggcccgatgccgacacgggcataaattccgaattcacgcataatcgcttgctgaatgctttcggcaattgtaaaaggatcaccgaacagccgcctgcttccggtcacgtcgagaaactgctcatcgatggagtagggttctacaagatcggtataccgttcaaacagttcggtaatcatgacggatacatcaatatactgctgcatccgcggacggacaataacggcgtcgggacatttggcctgcgcttcccacagccgttcggcattttttacgccgtatcgtttggcgagcggacaagccgcaagcacgacgccgctgcgtctttcgggatctcccgagacaatcacgggccggcttttgagatgaggcgcttccgctttttccacagacgcataaaacgattgcatatcaacaagaagaatatcagccataaaaaaacctccgggaacgtttgttctgtttttcattgtacccgaacaatgatcacgtttatactggtaaatcattccccggctggaagacgtgctgattcgtttgcttgaaaagaaatcatttacaattgcaaacaacccacatataattttttatattccaatgagaagagctgacattcattttgccggacgaaaaggagagtcaatcgataatggatattcgaacaattacctctgaagactatgaaatggttacgtctgttttgaatgaatggtggggcggcaggcagatgaaagacaaactgccgcgcttgttttttgaacattttcaggacacgagctttatcacgtacgggccggagggaatgaccggttttttaatcggttttcagtcacaatcagaccctgagacagcctacattcatttttccggtgtgcatccggatttcagaaaaatgcaaattggaaaacagctctacgatcgatttatggagacggtgaaaaaaaggggctgcacaaaagtcaattgcgtgacggcgcccgtgaataaagtatcaatcgcttatcatacaaaattaggctttgaagttgaaaaaggaaccaaaaccgtaaacggaatccctgtttttgcgaattatgacggtccgggagaagacagaattctgtttgtgaaatatatgtagagggggatgaatatgggttttttagctgacacgcccaaaccgccctattatgcggtcattttttcatcaataaagggaaaatatgatgaggaatatgagcatacggcagagcgcatgatgaatttggcaggcggacagccgggctttttaggcgcggaaagcgttcgggaggaaaacggctgcggcatcacggtttcctactgggacagcctggaggcgattaaaaggtggaaagaccatactgaccaccgggcggcaaaacaaaaaggaaaaagcgcctggtatgaagcgtacgcggtccgcattacgaagacggagtcacagcggatgtttgcgtcaaaaggggcggaagattgattacatttttacggcatacacaagaacagacggcgcgggaaattgcggcggttcaacgctgctcttatcaaaaagaagccgagctgatcggctttttcggcattccagccctgcatgaaacacccggtgacatacagcggtcacgggagacgtttgccggtttcagagaaaaagatcggcttgcaggcgtcatttcgtatgaaaaaaaaggatatgaccttgtcatatgcaggctgacggtgcacccgtccggctttcggaaaggaatcggacgggcgcttattcaatttgtgatcgaccaaaaccgggacgcccaaaaaatagaggcggctaccgccagtcaaaacgttccggcagtctctctctatttaaaaaccggcttcacagaagccggacagacagagacgccggaagggctgaccctctcgttttttcatctttatccgaagaggaaagcggaagttgttccgtacaagccggaatggaaagagatgtttgaaagagagaaggcggacttgatccgaatcttcggccccgcacttcattctgtcagccatatcggcagcacctccatcccgggaatggccgcaaaacccgttatcgatatactggcggaggtcaaagatatttcagatgctgaccgattcagcccgcagctggaagcactcggctatgaggcgcaaggggaaaacgggatagagggccggcgtttctttcaaaaaggcggcagcaagcgcacacaccacgtccacatatacgaaacaggccatccggatgtgaagcgccatctgctgttccgggattacctcactgaaaagcctgaaaaagcggctcaatacatggaactgaaacggcggctcgctaaggcatacccgtacgatacggcaaagtatagtgaagggaaaaatgactggatcaaggcggctgaacaagaggcaaaggactgggagagcgggcttctgtaaagaaagcagaaacaatgcatacagcggctcggtatgctacaatggcgaaaatgaaaaacggaggatcatctatgcaaatacatgtgacggatgcggcgaaacacacacttcagcaggcgatggacgccaacccggggaaaaaagcgcagctccgctatgacgcagaaggctgcgggtgcgcggtgagcggcgtgccgaccatctggctggcggacgaattaacgggacaatgcgaagccattgaaaccaacggacttccgctttacatccagacctcacaaaaagtgttttttgacgaggaaatgacaatcgattacaatgaaaaggcaaaaacgctcgtcttaaaaagcccggcagagatgctgagcccgagaatgagcatattagtaaagcagggagaaacggaaagtgaatcaaaagctgaaagccattaaacagacggcacagcataaaacgtgggtatcctttctgaacaacaaccacccgtacagtctgctgcactggtccatcggaggcgctgaatccgttcagaaggatgtctggctgcttcaggatgagatgaccttcaaagcgcaggagtttacgacaatcgacctcgccattgactggatcggagaaaatatggacgggattaccgacgttttatgacgggaaagcgaaagaaccagcatacgttctttcgcttttttacgtttgcgtcatggtatctaaaaaggtttgaacggctttgcggtagctctccggatttttggtgtacgacatggcatgcccgcccgattcggccagatagagcatcttcggtccgcgttttctgcggtgcagcaattcggaagaagcgggaggtatataatcatcttccttactgtgaataaacagcacgggctgccggtcggctgataaccgatagaggcgatacatcacggatacggtatccttctctcatccgcaaaaagaaatcagccaaaggcagaagcggccacggaggcagccggaactcccgcttcagtctgtaggcgagctgatcgcgaaagcttgcgaacggacagtccgcaatataaaaatcagcgcctttttcatcctgatgcccgcccgcgtataataaggccgtcaccgctcccatcgattccccgtggatgccgatttgaccgccgtctcccgttttgtgtctcacccaattcacggcttcttccaaatcatctttttcaaaatagccgtagctcgtcgttctgccgccgctttttccgtgcccgcggtggtcatatacgagcacattccagcctgaatctaaaaataaatccatgtatttcaatgaattgaacgaatttacggtaacgccgtgacaaataatcatggcgtttgccgtatgatgcggggcgacgtaaaagcctttgatctcatacccgtggcgtgacaggatgacggcctcttctttttccatggcctgaaaggaatcaaatctatcatgcccgtccgccgtttcttttttcatgatatcttcatccgtctttttcttcataaacataatgagattcgtaaaagcgaatccggcagccaaaaagactgcgcaagccgaaccgaacaccgccagccattttttcacacaggggccctcctttcatatgaaaaatccttcctccggcttttcaggaccgtgaacgttgccggcctccggcgctccgtggtacacttgcttcaccatattcagatacggggggcgtaatgatgaaaaagcagctgcctaaagaaaaacacagcttaaaagacgatctggaggaagatctgaaggccaggcttttgcaaatgaaaagtgagctgaaggaagaagacgagaaaaaacaggcgcagcaaaaagcggaacaaatcagaaagcgaaaagaaaaagaaaaacataaaagctttgaagagctgctgaatgaaagcagtctcgattggcacaaatataaataaaccggcatctgacaaggtgccggttttattgtttaagaacgatgggcttcgtatacgtcccgttttgtatggtattgcagggctttgatttcctggctgcttaaacgccgggcctctgcagccgaacagttttctctcagctgctcaagtgagctggctccggtgatgacagaagcgacggccggctgtgacagtaagtattgaagggaaagctccgtcatgctcaagtcaggtgcggcagcgccgatcgcttttttggtttcttccaattctgcaaaagaatatgttaaatacccgttctcttttacgcttgcggctgcttgatcaagcggtttttccgtaagaagccctttagcgacaggccctctggcgactacgctgattccgttctcctctaaaaggggaagccactcctcaggacgccggtccagcaggctgtattgcatcataacgcttgagatatttgattttttcacatattctttaatgacattcggacgaatcgaggaaatgccgtaataccggatgacgccttcctgttttaagtcctcaaacgcttcgatcgtttcgtcaatatgatcttccatcgtgccgccatgcagctgataaaggtcgatatagtccgttttcagccggcgcagactgtttttgaccgcttcttttatgtatcctttggaggcgtcccaatgccagccgtctttatcatcattccagcggtttccggctttcgtggctaaaatgatgtcgtgcctgcggtttttgacggcctccccgacaatttcctcatttctgccgaaatcataaagatcagcggtatctaaataattgattccaagctcgatcgcttcatccaaaatagacagcgcttcagctttatccgtgcccagcgacatacagccgagcccgatttcgcttatttctaaatcagaatgtcccagtgtgcgttttctcatcgtttcgctcctttttatagtcttttattgaccgtaatataaaggcgcgaagttttcaactgttaaggcccggtgatccaatctccgacatagcggaatgtccgtccgtattctttcagtttagcccgcacttcccacgcctttccgaccaatacgatacttttatccttccggtacaccttcaatcgaaaagcacctccctctcatgcatgtatgataaaatatatgaggcataatagagagacagaacgggagatgacatgatgaaacatttagaagaaaaaacacttgcgaaaaaaaagctgtatgacgggaaagtcatagatctttacttagaggatgtagagctcccgaacggaaaaacaagcaagcgggaaatcgtcaaacatccgggagcggtggccgtacttgcggtgaccgaagaaggaaaaatcattttggtaaaccagttcagaaagccgctggaacggacaatcgttgaaattccggccgggaagcttgaaaagggggaagagccggaacatacggcgttaagagagctcgaggaagaaacgggatatacggcggaaaccttgacgaaaatcaccgctttttatacatcacccgggtttgctgatgaaatcgtgcatctctttcttgcggaagggctttcgccgctggaagaaaagcgcgaactggatgaggatgaatttgtcgaagtcatgcaggtcacgcttgaagaggccgtgaagctgattgaatcccgcagggtgtatgacgcaaaaacggcgtacgcgattcagtatctgcagctgaaagaagcactgaaggaaaaatgatgaaaaccatctatgcggatctgcatattcatatcggccgcacctatacgggaaaaccggtcaaaatcaccggggccaaaacgttgacgctgcatcggattttagaagaggccagtgaggggaagggaattgaactattgggcatcatcgactgccattccccggaagtcatagaagaaatcgagcgcggaattgatgaaggcagataccgtgagctgaaagaaggcggcatccggtatcggaatacgacgcttctgttgggcagtgagcttgaaatctatgatcacacatgccgcgggccgattcacgttctcgtctttatgccgtctcttgccgaaatgaagatgttttctgagtggctcgcaaaaaggcttaaaaatatccatctcagttcccagcgtatttatgaaaccggtttgaatcttcaaaggaaaacaaaggaattgggcgggctgtttattcccgcccatatgttcaccccgcataaaagcctgtacggaaaaggggtcatatcttctttgacagaagttttcgacccggcgctcattgatgcggcggaactcggattaagctgcgacaccgacatggcttcgcgggtaacggaacttgatccgtatacatttttaacaaattctgatgcgcattccttaggaaaaatcggcagagaatataatgaaatgcttcttaaagaagcgaatttcacggaattttcgctggctttaaaagggaaggacggaagaaaaatcacggcgaattacgggctgaacccgaagctcgggaagtattaccggacggcttgcgaccgctgcggcagcccggttgaaaaaggagcttccgcctgtccggagtgcggggggaaaactatgacaaaaggggtcagtgaacggctggaggaactgagcggcccgaaaaaaagccgcgtgccgcggccgccgtatattcatcaaatcccgctgcagttcattccgggggtcgggccgaaaacgttagacaaactgaagcgggctttcgggacggagatggcgattcttcatcaggcgcaagaagaggaattggcgcatgtcgtccagcctaaaatagcggctgtcattcataaagcgcgcaccgggcagctcgtccttgaggccgggggcggagggacgtacggcagaatcaagtcgtaaaagccggattttagcggagctcctcctgcaccttctttttcgtgcggacaaacgcaatcaattcgatgatttcatcctgattcagcggctgtccgtcaacggtcagtgtgccgcggccttgtgcggcgtttgttaattcgatggtctgggtaaacggctccgcctttttttcagtgcgccccagtaaatcgtcgcacgtcgtgtcaaacagatcggcaagcgtgcccagcgcttcgaatgacggacgccggtatcctgattcatacccggcgtacgtgcttttggcgatgccgagacggtcagccgtatattgaagagaccaatttttcttttttctcagttcagttaaacgatctaaattcatattcaaaaccgctccttttcacttgagcaaattatatcatatcgatatgcaaaagtgtacgcgaattgaataataatcacttgattaatttcaatcgtctgtctataatttgattaaaagtatgcgaaaagcgaatgcttaacacatcttgagaaatggatgaagaggtgcagggtatgaaaaaattattgctgttaacaaccggaggaacaatcgcctcagtcgaaggagaaaacgggcttgcacccggggtgaaagcagacgaattgttaacctacgtatcaaaacttgataacgattacacgatggaaacccattcgttaatgaacatcgacagcacaaatatgcagcctgaatactgggccgaaatcgcaaatgctgtcaaagaaaaatatgacgcatatgacgggttcgtcattacgcacgggacagacacaatggcgtatacatcagcggcactgtcttatatgcttcagcatgctgataaaccgatcgtcattacgggttcgcaaattccgattacatttcaaaaaaccgatgccaaaaaaaatatcacggacgcgatccgcttcgcatgtgaaggggtgggcggcgtatacgtcgtatttgacggcagagtcattcaaggcacacgcgccattaaattaagaacgaaaagctatgatgcatttgagagcattaactatccgtatatcgcgtttattaccgaaaacggaattgaatacaacaaacaagtgcacatgccaaaagacgatgcctttacggtcaatacctcactttgcacggacgtgtgcctgctcaagctccacccggggctgaaaccggaaatgtttgacgcattaaagggcatgtacaaagggatcgtcattgaaagctacggcagcggcggcgtgccgtttgaaggaagagacattctcgccaaagtcaatgaaatgattgaaagcggcattgtcgtcgtcattacgacacaatgtcttgaagaaggagaggacatgagcgtctatgaagtcggccgaagagtcaatcaagatctcattatccgctccagaaatatgaacacggaagccatcgtgccgaaattaatgtgggcgctcggccagtctcacaacttggctgaagtcaaaaacattatggagacaccgatcgcagacgacgttgtactgtaaaaacatgactaccacaaagagaaagtagggttttagcatgacaaacgcgcaaaaagaatatcgtcaggaaaaagatttcctcggagaaaaacaaattgaagctgatgtgtattacggaatacaaacgctgcgcgcgaaagaaaactttccgattaccggctaccgcatccacgaagagatgattaatgcgctcgccatcgtcaaaaaagcggcggcgcttgccaacatggatgtaaaacggctgtatgaaggaatcggaaatgcgattgtccaggccgcagacgagattcttgaggggaaatggcatgaccaattcatcgtcgatccgatccaagggggagccggaacgtccatgaacatgaatgccaacgaagtaatcggcaacagggcccttgaaatcatgggccataaaaaaggtgaatacattcacctcagcccgaacacacacgtcaacatgtcccaatcgacgaacgacgtgttcccgacggcaatccatatttccaccttaaaacttttggataagctccttgatacgatggcgcatatgctgagtgtctttaaggataaagcgaaacaatttgattctgtcattaaaatggggcgcacacaccttcaggacgctgtgccgatccgtctcggacaggaatttgaagcatacagccgcgtgctcgagcgtgacataaagcgaattaaacaatcccgccagcatctgtatgaagtcaacatgggggcaacggccgtagggacggggcttaatgccgatccgcgctacatagaacaggttgtaaagcacctggctgacatcagcggactgccgcttgtcggcgccggccatttggttgacgccacacaaaacactgatgcgtatacggaagtttcagccgcgttgaaagtatgcatgatgaacatgtctaaaatcgccaacgatctgcgcttaatggcttcaggtccgcgcgcgggacttgcggaaatttcactgcccgcccgtcagccgggatcatccattatgcctgggaaagtcaaccctgtaatggcagagctgatcaaccaaatcgccttccaggtcatcgggaatgacaatacgatctgcctcgcttcagaagcgggccagctggagcttaacgtaatggagccggtactcgtatttaacctgcttcaatccatcagcatcatgaataacgggttccgttcatttaccgatcattgtctggcgggaattgaagccaacgaaaaacgtctgaagcaatacgtggaaaaaagcgtcggcgtcattacagcggtcaatccgcacctcggctatgaagcggctgcgcgaattgcccgtgaagccatcatgacggggcaatctgtaagagatctttgccttcaaaatgatgtactgacagaagaagaattggatatcattttgaatccgtatgaaatgacaaaaccggggattgccggaaaagatctattagaaaaataaattttaaagcaacaacagccgccttttcacgtttttcagtgaataggcggttgccatacaaagggatgaggcagtatagtataatttgttatatcatttgatgaaagcgttttagcttttttcttctagggggattttcttgtgaaagaggtcagattgccaaatttattggaaattattatcttattattcgggtttttagcacttgtcttatcgttcacagtgtttttagacctgccgatccagctagctctattaatatcctggtttttcgctattattctcggagtcaggctgggatattcatataaagacttgcaggattcgattgtcaccgggatatcaaacggtcttgaagcggtgttgattctcgtttcggtcggtgcgctcatcgggacatggattgccggcggtgttgtgccgacgttaatttattatggtttagagtttattaatcctcatattttccttctggctacactggttatttgttccgttatgtccgttgcgaccggaacatcgtggggaaccgtgggaaccgcggggatcgccatgattgccatcggagagggaatgggtataccgcttccgatcgtagcgggagccgttttgtccggcgcttacttcggagacaagctttcaccgctgtctgacagtacggtgcttgcctccacgctttctaaggtggatgtgctgtcgcacgtcagagcgatgatgtatctgtcaattccgtcctatattattacggccattctatttaccgtaacgggatttatatacggcggaaaaaatattgatctcgacaaagtggaatttttaaaatcttcattgcagaaaacgtttgatattcatatatggatgctcattccggctgttgtcgtcgttgtccttctgattttgaaaaagccgtctatgcccgttattatcatcggtgctttgcttggcgcaatctgggcttccgtctttcagggaatgaattttgccagtgccatcgcgactgcttataatggtttttctattaaaacggacgtcgaatttttaaacggcctgttaaaccgcggaggcattaccggtatgctggatacgttagtcgttatcctgttcggtctcggttttggaggaattcttgagaagctcggcgtattaaaagtgattgtctcaacttttgagaaaaagctgaccacaccgggaaatgtgacgctttcgacattgatcgtcgcccttttaggaaacattttcggctgtgcgatgtacgtgtcattgatcctgacgccgaaaatcatggagaacagttatgataaactgaaacttgacagaagagttttatcccggaacgcagaggtgggcggaacgcttacttcagggatggtgccgtggtctgataacggcatctatatggccggcattctcggcgtatccacattttcatatctgccgttcatgtggctcagttttgtatctatcggactggcaatattgtacggatacacggggaaattcatttggtacacgaaagaaaaatccttgcaatctcaaaaattgggttaggaggttcatttcatgattacaaagcatatgattcggacgttaatgattgaaacgccgactgttcccggaaatctcggaaaagtggcaaccgccatcggagtgatgggcggagatatcggggaagttgaaaccgttaaagtcggcccgaactacacaatgcgcaacatcacggtgcaggccgaaaatgaggagcagctgcaggaaatcattcaagccattgaagctctcggtgaaggcatccggcttcatacagtctcagatgaagtgctctctgctcatgaaggcggcaaaattcaaatgaaaagcaaaatgccgatccggacattggctgagcttggccgtgtttatacaccgggcgtcgccgatgtgtgccgactgattgaaaacgagcctgaaaaagcgtccatctatacgacaatcagcaattctgtcgccattgtcaccgacggcacggcgattctcggcctcggcaatatcggttctgtcgccggaatgcctgtaatggaagggaaagccgcgctttttgaccagctggcgggtatcagcggaattccgattttgcttgatacctctgatccggaagaaattattcgcacggtaaaacatatttctccggggttcagcggaatactgcttgaagatatcggttcgcctcactgctttgacattgaagaccgcctgaaagaagaactggatattccggttatgcacgatgatcagcacggcacggcggtcgtcacgctcgccgccgccatttccgcttgtaaaagcgccggtcttgatttaaaagaagcgaaggtcggacagatcggtctcggcgcggcaggcgtcgccatctgccggatgtttatggcatacggagtcaaagcggtctgcggaacggacaagtcagaagacgcaatgaaccgcctcgctcagtacggaggtcagccgcttggaagcatcaaagatttaatggacacgtgtgacattgtgatcagcaccaccggagttccgggtctcattaaaaaagaggatgtcagaaaaggacatgtcattctggccttatctaatccgaagccggagattgaaccggaagacgcattacaagccggagccgcttatgcagccgacggccgctcggtcaataatgttctcggcttcccggggattttccgcggcgcgctgaacgccaaaagcaagaaaatcgaccatgaaatgcttgtggcggccgcagaagccatcgcctcttgcacaaaacacggcgatctcgtgcctcagcctttggatgcggacgtgcatcaggctgtatcagcagccgtagaacgggccgcggcaggaaaataaacaactcttacagtaccggacatgtgccggtgctgtttttttagatgaataggaaacggaattcttaggcaggctaacagatagcaaaagacggaataaagaggtgtcaatgtggattattttccgctgatccatacaaatatttgggatgctgtgatcggcgtgccggtcgtcttatgcgttacacagctgatcaaagtgttctgccgggttccgggcatattcgttcccacgattgcccttgctgccggaaatgttgtgtctatcgttttcggtcaccatgaacacgtgtatgcggggattttcatgggatttttttacggatacgccgctatggggagctattcatctgccaaaacgtctctgcgcgcttaccggtcgaaacatgagccgtattcatgaacacatcgggatttttttgttatgataaagaaaaggcaaaaaggagcgattggcacatggcgaagagcaaaacgaaaaaaatgcgggagcatctcagaagaaacgggatgcgtgacgcagtcttgtcaagggggacggcgccgcctttcagcacccatgaaagagtgacgaaaactaaaaaagacaggcttgaaagaataaagcataaaaaaaggaacccctatgatcaccggagtgatgacgggggttctttttttatgcccgaatctcgcgcctttctatgatttctctgtcatgttttctcttttctttcatacaatctactaaatcaagtcaatagattagcgggaggaaagcggtatgagaaaacaatcgtacaaagaactgttttttcgccatgtaaaggatcatctgtcactttatatatttgtgttcgtcttgtttttgatgggggtcattttcggggcgatcatcgtcaacagcatgaccatcacgcagaaagaagatttgtattactatttaagcaagtttttcggacagctgtctgacggaaaacatgccggcgcttcagaaatgttttggcaggccgtctttcatgatgtaaaatatttggggctgatgtggattctcggtatttccgtgatcggtcttccggttattttcattatggtgttcttaaaaggaatcgtcgtcggcttcacggtcggttttttagtgaatcaaatggggatgaacgggtttttcctgtcatttatttcggttctgccgcaaaacatcgttctcattccagcatatcttatcatggggacatgctccatcgctttttcactgaaactgatccggcagctgtttgtcaaacgcagccttcatgacgcgccgatccaatggttcggacgctacgccttcgtactgattctcatcgttttcttctcggtcctcgcttcactgctcgaagcgtacatgtctccgctgtttatggaaaagctgtcatcacgcatattttagaattattatcacaaaataatacttttatttatcagtttataataattatagttggaactctgcgcgtattttgttataatgagtcatggaatgcggcgtaggagggaaagacatggaaaaccgtattgatcgaattaaaaagcagctgcactcgtcaagctacaagcttacgccacagcgggaagcaacggtaagagtgctgcttgaaaacgaagaagaccatttaagcgcagaagatgtatacctcctcgtaaaagagaaatctcctgaaattggtctcgctacagtataccgtacattagaattattaacagaattaaaagtcgttgataaaattaacttcggggacggcgtatcccgctacgaccttcgcaaagagggcgcggctcattttcatcaccatttggtgtgcatggagtgcggagccgtcgatgaaattgaagaagatctgcttgaagacgttgaagaagtgattgaacgtgattggaaatttaaaattaaagatcatagattgacttttcacggaatctgccaccgctgccgcggggatgaaacagagtaaaagcctatgaaccttttctgccaggaaagggttttttgctgtttttatgtataaaagcctttgaaattggcataaggtgtactaacagccgccaaagaaagggtcgatcgaaagatgggcagattcctgaaaacagccgcggatacgatcaaagtgtttattctgttcacaggttttaccgcgctgttctattatgctatgatatgggtgaattcagagtatgaaaactatcatcggtacgataaaccggaaggctccgccgtcaaagtggccaaaacggaacatgaggagaaagacggctggttcggccgattgatctttttttaccaaaacggggagtagatcaagagtgaaggatcaaattaaggatttcatccattatgtgagggttgaaagagggctgtccctaaatacgatgatgtcctatgagcgtgatctgaaaagttattctctcttcttaactgaaacccttcagatcacttcatggaatgatgtgacccgtcttcatattattcaatatttaaagcatataaaggactccgggaaatccggcaagacgtctgccaggcatttggcgtcgatccggtcttttcatcaatttctgttaagggaaaaagccgcggataaagatccttcggtacatattgaaacacaaaaaacagagcggacgcttccgaaagtattggcgcttcacgaagttgagcggttattggacacgcctaagcttgacagcccgttcggtctcagggataaagccatgcttgaactgctgtacgcaaccggcatccgggtcagcgagatgatcgagctgaaattatccgacgtccatttgacgatgggatttgtccgctgcttcggaaaagggcggaaagagcggattgtgccgattggtgaagccgcttcccatgcgatagaagcatacattgaaaaagccagagggaaattattaaagaaaaacgtaaccgaagcgctttttctgaatcatcacggcaggcagatcagccgtcagggattctggaaaaacctgaaaaaaatcgcccttgaagcggggattaaaaaagagctgacaccgcacacgctccggcactcttttgcaacgcacctgctcgaaaacggcgcggatctgcgcgccgtgcaggagatgctcggacatgccgatatttccacgacacaaatttatacgcatgtgacgaaaacaaggctgaaggacgtgtacaaacagtatcatccgcgagcttaggagccgctgccagaggggccgcggctttttttgccggattggcggaatacagagaaggttctaattatttgaatcggcattgtcaacaagaatgtaaacggtttatacttgagttgtctgacctctgtaagctacaatggacagatggaagaaaaggaggcttttatgatgtctgaatacaaatataaccgggtatttttaattgtaatggattctgtcggaatcggtgaagcgccggacgccgccgattttaatgatataggcgcaaatacgctcggacatatcgcagagcacatgaacggcttacatatgccccatatggcgcagctcggtctcggactgatcggagacattaagggcgtggaaaaaacggagcaccctcttgcgtactacggaaaaatgcaggaggcgtcaaacgggaaagatacgatgacggggcactgggagattatgggcctctacattgaaaaaccgtttaaagtgttcccggaaggattcccggatgaacttcttcaggaacttgagcggcgttcaggacggaaaatcatcggaaataagccggcttcaggcacggcgattctggacgagctcggaaaagaacatatggaaacgggtgcgctgatcgtttacacatcagcagattccgtgctgcagattgcggctcacgaagatgtcgttccgctggaagagctgtacagcatctgtgaaacggccagagaactgacgcttgatccgaagtacatggtcggccggattatcgcaagaccgttcgtcggagagccgggcagcttcaaacgcacgccgaaccgtcatgattatgcgctcaaaccgttcggccgcacggtaatgaacggaatgaaagacagcggattagacgtcatttccatcggcaaaatttctgatatttatgacggagaaggcattacatcttcccgccgcacggtatctaatatggatggcatggacaaagtgattgaaacgctcggtgaagagtttacgggcctgagctttgccaacctcgttgattttgacgcgctgtacggacaccgccgcgatccggaagggtacggaaaagcgcttgaggaattcgacgcgaggcttccggaagtgtttgaaaaaatgaaagaagacgatctgcttattatcactgcggatcacggcaatgatcctgtccatcacggcacggatcacacgcgggagtatgtgccgcttcttgtttacagcaaaaagcacaaacatacagaacagctgccgcttgcggatacatttgccgatatcggcgcaactattgccgataattttaaaacggaaaagccggaatacggaaaaagctttttatcaagattacagtagggggactttttttgaaacaaaagatcgaacgtgctgctgcatttattaaagaacacgtgaaagaaacaccaaagatcggtctgattttagggtcagggctcggcgtattggccgatgaaattgaaggagctgtcaagcttacatatgaaacgatccctgattttccggtctcaacggtagaaggccatgccggccagcttgtgatgggaacgcttgaaggcgtgcaggtcatcgcgatgcagggccgctttcattactatgaaggctactcaatggatcaggtcacatttccagtccgcgtgatgaaagcgctcggcgttgaatctctcgtcgtgacgaatgcagccggcggtatcaacactgaattccgcgccggcgatctgatgattattacagaccatatcaactttacaggcaccaacccgttaatcgggccgaacgaagctgaattcggagcgagattcccggacatgtcagaagcctatgacaaagagctgtcaagcttggctgaaaaaacggccgatgagctgggcattcctgttcaaaaaggtgtgtatacagctgttacggggccgtcttacgaaacacctgctgaggttcggtttttaagaacgatggggtctgacgctgtcggcatgtcgaccgtgccggaagtcatcgtcgccaaccacgcggggatacgcgtgctcggcatctcatgcatttccaacgcggcggcgggtattcttgaccagccgttatctcatgaagaagtaatggaaatgacggaaaaagtaaaaggcggctttttgaagcttgtcaaagccgtagtcgcacgatctcaaaaataagtcagcataagtcagctgtttcttcggaagcagctgtttttttgtgccctcaacacgaaacattttccagatgaggcgtataaaaccaccggatttggaaaaaataaaaaggattatgaaatggagggctttggagatgaaacgtcttatatccactttgttgattggcattttattaacggcatcagcaccgtccgcttttgcaaagccggacggaaaacatacatcggagctcgctcatgaagccaaaagcgccgtgctgattgaacgcgatacgggaagcattctttataacaagaacagccgggagcgtctggcgccggcaagcatgacaaaaatcatgaccatgcttttaatcatggaagcgcttgacaaagggaaaataaagatgagcgataaagtcaggacgagtgaacacgccgcgtccatgggcggatcacagattttccttgaacccggagaagaaatgacggtaaaagaaatgctcaaaggaattgcgatagcttccggaaatgacgcatctgtcgcaatggcggagtatatcgccggttcagaagaggatttcgtcagccggatgaacaaaaaagcaaaagaattgggattgaaagatacctccttcaaaaacccgacaggactgcctgaaaaagaccattacagctctgcttatgacatggcgaaaatggcgaaggaattattaaagtacgataaaatcactcaatttacgggaacgtatgaggattatttaagagaaaatacagacaaaaagttctggctcgtcaatacaaaccggctgatcaaattttacccgggtgtagacggcgtgaagacgggctttacaggcgaagcgaagtattgtttaaccgccaccgctaaaaaagggaatatgagggtcattgctgtcgttttcggagccagcaccccgaaagaaagaaacgcccaagtgaccaaaatgcttgattacgccttcagccagttcaaaacacacccgctgtacaaacggaatcaaatcgtcggaacggtaaaagtgaaaaaaggaaaacagaaactgatcaagctgaccacatctgagccgatttctcttctggccaaaaagggagagaacatggacaaagtaaaaaaagaagtgaaaatcaacggcaatgtaacggctccggttaaaaaaggagaggtgctcggcagcctcgttctgaaaaaagacggaaaggtgctcgttgaaagcccggtcacggcaaaagacgacatggaaaaagcgggttttctcacttttctgaagcggacgatgggagattggacaaaatttaaataatcatggcgaacgggcactagttttgtcatagtgaaggaattgctttcccgaaaatcgaaacactcattatccgatcatacaaggaggaatgagcatgagccttggaattgactttcatgtcaaagaatccgtgctttgtattcgattaacaggtgaactcgaccatcatacggcagaatcattaaaacaaaaggttactgaatcgctggaggctgacagcatccgtcacattgtgctgaaccttgaagatcttaccttcatggacagctccggcctcggcgtgattttagggcgttataaacaaattaaacagctcggcggagaaatggtcgtgtgcgcgatttcgccagcggtgagacgtctgtttgacatgtccggcctgtttaaaatcatcaggttcgaacaatcggaacaaaaagcgcttttaacgttgggggtggcttcatgaaaaacgagatgcatcttgaattttcagccctcagtcagaacgaatcgtttgcgcgcgtaacggttgcttcttttatcgcgcagcttgacccgacgatggatgagctgacggaaatcaagaccgtcgtatcagaagcggtaacaaacgcaatcatccacggctatgaagaaaactgcgacggaaaggtgtacatctccgttacgctggaggatcatgtcgtctatctgaccatacgtgatgaaggcctcgggatcacggatcttgaggaagcgcgccagccgctctttacgacaaaacccgagcttgagcgctccggaatgggctttaccattatggaaaactttatggatgatgtcacgattgattcctcgccggagatgggaacgacgatacgcttaacaaaacacctatcaaaaagcaaagcgctttgtaattaaggagatttgttatggatgtggaggttaagaaaaacagcaaaaacgcgcagctcaaggaccatgaagtcaaagaattaatcaaaaagagccaagagggcgaccagcaggcaagagacctcctcatagaaaaaaacatgcgtcttgtgtggtccgtcgttcaaaggtttttaaacagaggctatgagccggacgatctgtttcagatcggctgtatcggattattaaaatccgttgataaattcgatttgtcctatgatgtccgtttttcaacttatgccgtgccgatgattatcggagaaatccagcgcttcatccgtgatgacggaaccgtcaaagtatcaagatctttaaaagagctcggcaataaaatacgccgggcgaaagatgaactgtcaaaaacatacggaagagtgccgaccgtccaggaaatcgcggatcatttagaaattgatgcggaggatgtggtgcttgcgcaggaagcggtgcgggcgccttcatccattcatgagaccgtgtatgaaaatgacggagacccgatcaccctgcttgatcagatcgccgatcattcagaagagaagtggtttgacaaaatcgccctcaaggaagcgatcagtgatttggaagaacgggaaaaactcattgtctatctgagatattataaagatcagacacagtcggaagtagccgaacggctcgggatttcccaagtccaggtatcgaggctggagaaaaaaatattaaagcagattaaagtgcagatggatcatacggaaagctgaccttttacgggccggctttttttatttgtgcatcggtggtaatttatggtcttttgcggctgatgaatgagaacaaaagtgaaccacatactacatatataaccacccgaaagatggtgatgcaagatggaaagacgaatatttctcagacttcgccaccgcgtgaaggctcataccggagatatcatcacagtcggcgacgccgcgcagattgcgggacagcaaaagctgaaaaaaaaactgtcggcactgccgctgtataaggtcacgaaaaaagacaaaaatatcgtcgtgctggacatcataaaagtgctgaaaaccattcataccgcttttcccgcgcttgatgtacaggccgtcggcggcgctgaaacgatagtggaaatccattaccagaaaaagcagctgtcagccgttttattcgtcggtgtctggctcctgctttttatcggttcatgtcttgccattatgaattttcatgaagatgtcagtatgagagaagttcatatcgccttatatgaaatcataacgggcgaacggaatgaatacccgtatctgcttcagattccatacagcatcggcctcggtctcggtatgatcgtcttttttaatcacatcttcaaaaaacgcctgaatgaagagccaagcccgctggaagtcgagatgtttaattatcagcttgatctcgatcattatgtcgcaatgcacgaaaatgaagagacgatgaaagatctgcatgatcgttagcattcttttcgttgtatttgtcgggcttggcggagggctgaccgtgggcgcgggctttgtggcttttttaaccgttatgggaatcgtcccccgccttatgcagctgacaaaaacaatgcgctttgtacaggcctacgaaggagcagttatttcaggagctgtgttcggcggctgggaaaccttaaatatgaatcatttttttttatctgaatggctggccgttccggtcgggcttttggccggcatgtttatcggcatgctggccgccgcgcttacagaagtgctgaatgtgcttcccattcttgccaaacggatcggcttcggcagcaaaatcattatattgctgatggccattgtgttcggcaaaatagccggctctttatttcattggctgtattttatccatcattcataaggaggaaccgacgtgacaaacttaaaagaaaattacaaaacaaaagtgaaagactatcagccgaaaccgccatatgtttggaattgcgtcaaagcctttctgatcggcggtttgatctgtctgatcggacaggctcttcaagacttttacatccacttttttaattttaatgaaaaaacagcgggcaacccgacggccgccactcttattttaatttccgcccttttgaccggattcggcatttatgacagactcgggcagtttgccggagcgggttcagccgtgccggtgacgggttttgcaaacagtatgacaagcgcggctctggaacacagaagtgaaggactcgtgctcggagtagcgacaaacatgtttaaattggcgggaaacgtcattgtattcggcgtcgtggcagcctatatcgtaggcctgatacggtttgcttgtgaaaaactgttttcgtaggaggagaaaaaatgaaattaaccggaaagcaaacctgggtgtttgaaaacccgttatttgtaaatgcggcggggacggcagccggaccgaaagaaaaagacggcccgctcggttcgctgtttgataagacatacgatgaaatgcattgcaatcagaaaaactgggaaatggcggaacgtcagttaatggaagatgccatcaactcagctttgcaaaaacagaatttgaaaaagagcgatattgatttgttactcgcgggggatcttttaaatcaaaatgtgaccgccaactacgtcgccagacatctgaaaattccgttcctctgtctgttcggcgcctgttcgacatcaatggaaacgattgccgtcgcatccgcgctcattgacggcggttttgcgaaccgggcgatcgcagccacgagcagccataacgcgacggcagaacggcaattccgcaatccgacggagtatggcgggcaaaaaccggataccgccacttcaacggtcacggggggcggggcggtcatcatcagccaaaacccttctgatatcaagattacaagcgcaacagtgggaaaagtaagcgacctcgggattacggacccgttcgatatgggatccgccatggcgcccgctgccgccgacacaatcaaacagcacctgcaggacttaaaccgcacggcggatgattatgatctgattttaacgggagacctttcaggcgtcggctcgccgatcgtgaaagatttgctcaaagaagaaggctatcccgccggaacgaaacacgatgactgcggtcttctcatctatacgccggaccagcaggtgtttgcgggcggaagcggctgcgcctgctccgcgcttgttacgtacacacatatttttaatcaattaaaatcaggggctctgaacagggtgctcgttgtcgcgacaggagcgcttttaagtccgacaatgatccagcagaaagaaaccattccgaccatcgcgcacggtgtggtatttgagcgggcgggaggtgcatcataaatggaatatctgttggcttttgtttgcgggggaatcatatgcattatcggtcagctgctgcttgacatttttaaactgacacccgcccatgtgatgacaacttttgtcgtcatcggcgccttgttggatgggttcggaatatatgacaaatttatcgaatttgcaggtgcgggcgcgacggttcccattgtcagcttcggtcacagcttattgcacggcgccatgcatcaagctcacgagcatggatttatcgggatcgccatggggatttttgaacttacttccgccggtatatcttcagcgattttattcgcatttcttgtagccattatttttaaaccgaaaggataatgcctgatgacgaaacggaaggtcattcttgtgacagacggggacgtatacgccgccaaaacaattgaatatgccgcggaaaaagcaggcgggcggtgtatttcccaatcaaagggcaatccgtcaaccagaagcggccccgaacttgttcagctgattaaagccgcgccgaatgacccggtgtttgtcatgtttgacgattcaggcctgcaaggggaagggccgggcgaaacggcgctgaaatatgtcgcctcacatcaggacattgaagtgctgggggtgattgcggtcgcttctaagacccatcaggctgaatggacgaaagtcgatgtctccattgaccgtgatggagaagtgacggagtatggcgtcgataaaaccggaatgagagaaatggacgagcacagaatgaacggagatacggtgtattgtctggataaattggacgttcctctcattgtgggcatcggcgacataggaaagatggggagaaaagatgacatatccaaaggctcgccgattacgatgaaggcggtcgaattcattttagaaaggagcgaaagtcatgccggaaaaaccggaaaacatgatcaaggtataccgggatcctagaaaaaatgaacaattttttaaagaccgcgtcggtatgggaacgagctatgatgtcggcgtccgcaaagttcgagtattagaccgggaagtccagatttactttgtcaacggattaaccgatactttgtttatcattcatttaatggaacagctcgtcgacgtcaataattatgatgagaatgcggatgaagcgattgacgttgttgaaaacaggcttgtcaatcagcaggtccaaaaagtcaaaacgctcgacgaagcaacagatcaagtgctttccggacttgtggccgttatcgttgaagacgcgggcttcgcctttatcgttgacgtcagaagttaccccggacgcacaccggaagaaccggatacggaaaaggtcgtccgcggggcaagagacggttttatcgaaaatatcgtcattaatacagcattgatcagaagacgaatcagagacgaaaggctccgcgtcaaaattacgaaagtcggcgagcgctctaagaccgatcttgccattgtgtatatagaagacatcgcggacccggaccttgtcagcatcgtcgaaaacgaagtgaatgcgattgacattgacggattgacgatgtctgataaaacagtggaagaattcatcgtcaaacagggctacaacccgtttccgatggtcagatacacggagcggccggatgtggccgccaatcacattttggaagggcacgtcatcatcgtcgttgatacgtcaccgagcgtgatcataacgccgacaacgatttttcaccatgttcagcatgcggaagaatacaggcaggcgccttcagtgggaacatttttaagatggatcaggttcttcggtattatcgcttcaacggttctgcttccgatctggtttctctttgttctcgaaccgtctcttctgcctgaaagattggattttatcggtttaaataaaaatacgcacatcccgatcattctgcaaatctttttagccgatttggggattgagtttctcaggatggccgcgatccatacgccgaccgctttatccaccgccatgggtctgattgcggcggtgctgatcggtcaaatcgccatagcggtggggctgttttcagcagaagtgattctgtatgtatcgatcgccgccatcggatcatttaccacgccgagttatgagctcagcctcgccaataaaatgatacgcctcatcttaatggtgctcgtggccattttccaagtgaaaggctttgtgataggctttacattgctgctgatcataatggcgaatatccgttcgtttcatacgccgtatttatggccgtttttaccgtttaacggcaaggcgctgtggcaggtgctcgtccggacgacagtgccgggagcgaaagtcagaccgagcattgttcacccgaaagaccgtcaaagacagccaagcggttcataatcgcattgaaaccgacagaagattatgatattgtatgtcttaacttatacgggacttgtataaggacagctcaaaagaagctgtccttttcacccataggcggatcagaaagagggaatgagcattgttcttacatggcacaagcagacaaaacaaactaggtcatttggaaatcggaggtgtggacgcgctgtatttagcggagcattacggcacgcctctttatgtttacgatgtggctttaatacgtgagcgcgctaaaagctttaaacaggcattcattgacgcggatttaaaggcgcaggtcgcgtacgcgagcaaggcgttttcttccgttgcgatgatacagctcgctgagcaggaggggctctcattggacgttgtatccggcggagagctgtttacggcggttgcggctggttttccggctgacaggattcattttcacggcaacaacaaaagcaaagaagagttgaaaatggcgctcgatcatcaaatcggctgcatcgtcgttgataatttttatgaaatatccttactcgcggaactgtgccgcaaatcagggcgcacaatggatgtgcttctccggatcactccgggggtagaggcccatacgcatgattatattacaacggggcaggaagattccaaattcggttttgatctgcataacgggcaaatagaaaaggcgattgaacaagtattgcagtcagaccatatccgccttctcggcgttcactgccacatcggatcgcaaatttttgatacggcgggctttgtgctggccgcagaaaaaatctttgcaaaactgaatgaatggagagaatcattcggctttgtctctgaagtgctgaatttagggggcggcttcggcatccgctacacggaagaggatgaaccccttcatcccgccgtttatgtggaaaaaattatcgaagcggtaaaagaaaacgcagcgctgcacgcttttgacattccggagatctggattgaaccgggacgctcgctcgtcggagatgccggaacgacgctttataccatcggttcgcaaaaagaagtgcccggcacccgtaaatatgcagcggttgacgggggcatgagcgataatatccgtcctgcgctttatcaggcgaaatatgaagccgtatcggcaaacagaatcggagaacaccacgacaaaacggtatccatcgcgggtaagtgctgtgaaagcggggatatgctcatttgggatatagaccttccggaagtgaaagaaggcgatcttctcgccgttttctgcacgggagcgtacggatacagcatggctaacaactacaaccgtattccgcgtcccgccgtcgtttttgtggaagacggcgaagcgcatcttgtcattagaagagaaacttatgaagacattgtaaaactggatctgccgtttaagactggggtcaaacaataaataaaaaagagaccggaacaatggcgtccggtctctttttgcgttcagctgtcagaacttgatccgctgtctcctgtaaatacagacacgatcgcattccaaatcgaagcgaagaaatcaataactttttgaacaaagcttttgccttcatcggattgaatgaacttcgtgattttgtcttttgccttatcgagctggctgccgacttggccccaatcaatctttgcatttttcattttattaaacaatgaaacgagctggtctttttgagcgtcagtcagtgtaatgttaaggtttgaagccgcatcatcgacctttttctcgattccttcttttgtatcgggcacaccgtttttcgcgaaatcatctttaatgtttgcgataagcgcggaggcgtttttatccccgattttatccccgagatttgaagtggtgacaagctcttggttggcgacctgttttacatcttctgaaatcgctttgtctgatgagacttcatatgccttgatgattcccgttaatgctgcggtgcctgatacctcaaacggcgccgtcacgtatactttcgcatctttcactcctgctgtcatcagggcgtttaagtacatttcatccgtaatggaatcgatattatgggtcttaacgtcaagcccggaccctttctttgccaccgtaatggatgacgaagagatggctcttgtgccgatttgggcattcgatatatattttcccagatattcatgttcttctttatttgtgaccgtcacttttgtcgcgttatcagggacatttaattcgtcaagcactttctgacggttttcgtttgacagatccgcccccagtgtgacgatgacatctccgactgcggcatcggccaggctgattttcggtattgtgcacaatacaacggccgccgccagcaatccaatccacatttttttcaaagcggttaacctccttcttttcacaaatgccgttttgaagcggtttgtgaggacctgcgagaagcagttccgatacatagacggctgtgaagctgttctggtttcattttctttctgcggaagcggggagattcgttttccggctgaaggtgtggtataatagccgcgaaaagaagagcagaggcctcttccttcaaaagaatatcaaaaagaaagccggcttacaattgaaattcatattaaagaaggctttgacaaaaaacaatacggaagtaggaatgagaatgaaaactggttacatcgaaatggaaaacggcagcagaatcgaatttgaactttatccgaatgaagcgcctaatacagtcgctaactttgaaaatctggcgaatacgggcttttatgacggcgttattttccaccgcgtgattccgggctttgtcagccaaggcggagatccgactgggacaggcatgggcggaagcggaaaaacgatcaaatgtgaaacagaaggcaatccgcataaacacgaagccggttctttatcaatggcgcatgccggtaaagacacgggttcaagccaattcttcatcgtacatgagccgcagccgcatttaaacggcgttcatactgtattcggaaaagtgacaagcggtttagagcatgcgaaaaacatgtctaacggagacaaaatgaaagaaatccgtgtagaaggataatgacggaaaacccgcctttttcaggcgggttttttttatgtatatgaaaattctcatgtgtaaatcatgaaaaaatacatatatgaacatcggtgatcattctggtatagtgaaaaagaccgattacaacaatgaaaagaggtagaaacgttggttcaattggcaaccgttttatttgtcattatcattctcgcacttatgatttggttcagggtaaaaaagggaaacaggccgattaaaggcggcggcttaggcatcattctcccgcttttgattatcgccgtcatttttacattcagtatcagccagctcatgaatatcccgggaaagccgtttcattttcccgctctttgggagctcgccatcgccggactgttaggcgcggtattcggtatcatcatgctgtcgcaaaccgcctatgaaatccgggaagacggctttgtctactccaagcggaataaaaactttaaatatgtcattatcgcgattattgcgatccgtatcgcactcagccaatatttcaaaagcattgacgcggctgaattcgccgttttaacgatggagcttgcttttgtgtatttgtgcatttggcggatcggaagcttcgtgaaataccgtaaaatcagcagatccggcttataaaatgaaaaaaagggatggggtgcggggcttatttgccctctgtgcagggattcatggtaaaataaaaatgaccatggctaatgggaggaaatcacttgaaatcagaaaaagaaaaaacttctaaaaaaagcgccgtacttgattgggcgaaagccattatcatcgctgtcgttctggcactgctcatccgaaactttttatttgccccttatctcgttgatggtagatcaatggatccgacgctgcatgaccgcgagagaatctttgtcaatatgacggtcaaatacataagcgacttcaaacgcgaccagatcgtcgtgctgaacggagaaaatgagcactatgtcaaacggattatcggacttcccggcgacacggtgcaaatgaaaaacgatcagctgtatatcaacggcaaaaaagtgtccgaaccgtatttagcggcaaataagcacaaggcgaagcaagacggctatgaccggctgacagaagacttcggcccggtgaaagtgccggacgacaaatatttcgtcatgggtgataaccgcagagaatctatggacagccgcaacggcctcggtctttttacaaaaaaacaaatagcgggcacatcaaaattcgtcttcttcccgtttaacgaaattcgcaagacgaaataaaccgtacaggcagttttcttcatgagaaaactgctttttttatataaatttatctctccaccctcaaaaacagaacataaattcgtatatctatttaatagatagaaagttttacagatacatgaaacatcttccctttatgaaacgttatatgaataactcacgcagggaagaacggttttctattcatgaaaaaaaggaatatgacatagtaatgaatagattgatacgggctggaggtagaaaaatgggaagaattaaaacaaaagcagccattttacttgtactgctgctgttattagcgggcggttatatggtcataaacgatattgaactgaaagacgtgccgactgcaatcggacaaaccctgtcccaggaaaaagaagaatatacagtcaaaacatataaaattacgaaaatcgaaggaactgagtaccacggtacggcagcgaacggcacaaaaattatttttaacggcgacaagctgaagcaggatctctccgatgtgcaaaaaggtgataagattaaagcgtatttcagcaaatcaaaccggattgacggcttattgaaggtcgtcaaagtgaacgaataaataaagacgccttttatgggaaaagggcgctttttatttttctgaataatgaggtgcaaattcattgcgcctgccgcaaaggatgttataatagcggataaggacaaaaaaatattgattgtatccttcggggctgggtgaaaatcccgaccggcggtaataaggcgctttgcgctttacagcccgtgacccgtatgcatctgtatacggtggattcagtgaaaagctgaagccgacagtgaaagtctggatgggagaaggatgagagaagctatgcaaaaaataaacttactgtatagtcttatttcctatggattaaaactggcaaagccccgaactgtgtaaacattcggggcttttttgacgccaaattgcgtggaagaagggagggataacaatggatgaatattatatgaatacggcaatagaacttgccagacgcggtgaaggacagacacagtccaatcctcttgtcggcgctgtcgtcgtcaaaaacggacagatcgtcggaatgggcgcccatttgcaatacggagaagcgcatgccgaggttcacgcgattaatatggccggcagacacgcaaaaggcgccgatttgtatgtgacgctggagccttgcagccattacggaaaaacaccgccatgcgccgaactgataataaagtcggggataaaaagggtgttcattgctgtgaaagatccgaatccgcttgtagccggaaaaggcatcggaatgctggaagcagcgggcatcgaagtgaaaaccggccttctcaggcagcaggcagaagagctgaataaaatgtttcttcacttcatgcggaccggacttccgtatgtcaccttgaaagcggccgcgagccttgacgggaaaacagcgaccgaaaccggtgacagcaaatggattacatcagaggcggcaaggcttgatgcccagcaatacaggaaatcgcatcaaagcattcttgtcggagcaggcacagtcaaagccgataatccgagcctgacctgcaggcttcctgatgcggtgaagcagccggtcagagtgattctcgatacaaagctgaccattcctgaaacggcaaatgtgctcactgacggcgctgcgccgacatggatatttacggccaaaggtgcagacgtgcaaaagaaagaccggctgaccgcactcggaataaaagtttttccgctggaaacagaccgcattcacatccctgaggtgctcagtgttctcgctgaaaacggaataatgtccgtttatgtggaaggcggagcatccgtacacggaagttttgtgaaggaaggctgtttccaagagcttcatttctatttcgcccctaaattaatcggaggaacgcttgctcccagcttgatctccggtgaaggttttcaatcaatgaaagatgtcccccatttgcaattcacacaaatcacccaaatcgggccggatataaaactgacggccatacctaaagatggaaaggatggtgacgatgtttacaggaatcgttgaagaaacaggcacgatccaagcaatcgaaaagacaggcctttccatggcattaaccatcgccgcttcaaaagtgacaagtgatgtgaaacttggcgacagcattgcggtaaacggcatctgcctgaccgtaaccggattttctgacaatcaatttacggttgatgtcatgccggaaacagtgaaatccacttcgctgaacggcttgtcaaaaggcagtaaagtaaacctggaaagagcgatgtccgccaacggacggttcggcggccactttgtatcagggcatgtggacggaacggcggaaattacgcggatcgagaaaaaaagcaacgcggtctattacgatttaaaactttcgccggaattgacaaaaacgctcgtattgaaaggttcaattacggtagacggcgtgagcctgacgattttcggtctatcagatgaaagcgtgacggtatccatcattccgcataccatctcagaaacgatttttcagacgaaaacagtcggatcgaccgtaaatattgagtgtgacatgatcggcaaatacttataccgctttttgcacaaaacagaacaaacgaaaagcaatcaaactatcacggaagcctttttaagcgagaacggcttttagaaaggaagatcgatatgtttcatccgatagaagaggcgttagaggcgctgaaaaaaggtgaagtcatcattgttgtcgatgatgaagacagagaaaacgaaggagatttcgtagcgctggctgagcatgccacgcctgaagtggtgaattttatggcgacccatgggagaggtctgatctgcacgccgctgtctgaagacatcgccggccggctggatcttcacccgatggtcgatcataatacggactcacatgagaccgcctttacggtcagtattgaccacaggctgacaaaaacgggcatcagcgctcaagaacgttcttttaccattcaggcgctgttgaacgaggaatctgtgtctgacgattttcagcgtccgggccacattttccccttaatcgcaaaaaaaggaggcgtcctgaagcgggcgggccatacggaagcagccgttgaccttgcaaaagcctgcggatctcagggagcgggcgtcatttgtgaaattatgaatgaagacggcacaatggccagagtgccggagttagccgaaatcgccgaacgtcaccagctgaaaatgattacgataaaagacttaatagagtaccgttacaacattacgacacttgtgaacagagaagttgatattacgctgccgactgacttcggcacgtttagagtttacggatatacaaacgaggttgacggaaaagaacatctcgcctttgtcatgggggatgtcccgtttaacagcgaacccgttcttgtcagagtgcactcagaatgcctgacgggcgatgtgtttgcatcccatcgctgtgattgcggacctcagcttcatgccgcgcttgcgcaaattgctgaagaaggccgcggcgttctattgtatttgcgccaggaaggcagaggaatcggtttaatcaataagctgaaggcgtaccgattgcaggaacaagggtacgacacggttgaagcgaacgaagcgctcggctttctgcctgatctgcgcaactacggcatcggcgcccagattctccgcgacttaggggttcagcatatgaaacttttaaccaataacccccggaaaatcgccggcctcgaaggatacggtctcagcatttcggaacgggtgccgcttcaaatggaagcgagtgagcataacaagcagtatttacagaccaaaatgaaaaaacttggacatctgcttcatttctaaaaacaaatctcacaaaaaaggatggataacatatgaatatcatacaaggaaacctagtaggaacaggacttaaaatcggaatcgtcgtcggcagatttaatgaatttataacgagcaagctgttaagcggagcggaagacacgctgcttcgccacggtgtagaatcaaacgacattgacgtcgcttgggtgccgggagcgtttgaaatcccgtttgcggcaaagaaaatggcggaaacgaaaaaatacgatgccgtcattacgctcggcacggttatcagaggagcgacaacgcattatgactatgtctgcaatgaagcggcaaaaggcatcgcccaggcgggaacggcgacgggcgtcccggttatcttcggcatcgtgacgactgaaaccattgagcaggccatcgaacgagccggaacaaaagccggaaataagggagcggattgcgcagtatctgccattgaaatggcaaatttaaaccgttcatttgaataatttgttgaaaagcgtttaaaaccgcggcgaaaatgatataatgtgagaaaacggatcgcctttatgtatccgtttgataggacatgaatggacattttggatatagaggggtttttatgttaattcgttataaaaaatcgtttgaaaagattgcgatgggtcttctgtcatttatgccgaatgaaaaagatctcaagcagcttcagcagacaataaaggactatgaaacggatactggccgccagctctttctttggaaagaggatgaagatatcgtcggagcgatcggagtcgaaaaaaaggactcagaggttgaaatccggcatatcagcgtgaatccttctcaccgccatcaaggaatcggaaagcaaatgatggacgccttaaaacgtctgttcaaaacggaggcactcgttccgaatgaattaacgcaaagcttttttgaacgctgtcaacatcaaaaagatcaggatatctcatataataactgacaaatgctcccggaatcttcacggtttcgggagctgttttgatatagaaaaagcagggctgaccgtcagcctctgcttttttttcttctctcaatttcccgttcgcgttccttaatgacatccgtcctgtcccgcaggcggtgtttatgaataagaaaggtatctgatacgccgtcttgcccccatgtatagccctttcggcggcattcggcaagacatgcttctttcagggcttcatctgtaatcggaagcataacacttctgtaaggcaggcccgcttctatatcgtctgacagcgtttctatcagctcaatcagcttcggatggctgagaccgagagaacagaccgcctgcttttcagaccggagaatacgtaagctgttggcaatcagccgtttcgccccggcttcatttcccctgcgctggtgatacagagcgacggcaagctgaatcaggccgacccaatgaatgctccgcttttcagccgggctttctttccaatattcctctaacagttcatgacattcaaaataatctcttgatgcgtgaaattcggccaaaaagccgatataagctttaggatacaagccgcttcctccttttatgctaaaaccagtgtaccacagcgctttgaaaaggaaaaaagagcggcttggtgtctgaagcctgaggaactagcagatgtaagatgctcctacgacaacgagcaaaataaacagaacgacaattaatgcaaaacctccgccgaaacaagctccgctcatgtgaaatcagcctccctttgtttcaagtttacacggctatcctatgtgcatccgcctttaaaggtataggcgtatatcttctttttcagtattttctaaataacggaggacgtgtataaaagtattggacgagagcatttcggtggattatactaaagggtagccagtttttccggcaatgagagtgatactgaaaatggtgagataatggtagaatatcaagtgaaaattgatacgtttgaaggcccattggacctgctgcttcatctgattaaccgtcttgaaatcgacatatatgacatacccgtggcaaccattactgaacaatatttattatatgtacatacaatgcaagagcttgaacttgatgtcgccagtgaatatctggtcatggcggcgacgcttctcagcattaaaagcagaatgctgcttccgaaacaagaagaagagctgtttgaagacgaaatgcttgaagaagaagaccctcgggacgagctgattgaaaagctgattgagtatagaaagtataaaaccgctgcgaaggatttaaaagagcgggaagaagaaagacaaaagtcatttacaaagccgccgagtgatttaagtgagtatgcaaaagaaatcaaacagaccgagcagaaactgtcggtgaccgtttatgacatgatcggcgcgtttcaaaaggtgcttcagcgtaaaaaaatcacgcggccgaaagaaacgaccattacaagacaggaaataccgattgaagacagaatgaaagaaatcgtaaaaagcttaaaaacggcggggagaagaataaacttcacggagctttttccttctcggcaaagggaccatctcgtcgtgacgtttttagcagtcctggaactgatgaaaaatcagcagattatcattgaacaggaagaaaacttttcagatatatacattacggggagtgaatccattcatggcgtttgatatcgtgaattggaaagcgattgtggaagccctgctgtatgcggcgggtgatgaaggactgaccaaaaagcaattggtgacggtgcttgaaatagaagaagcggaactggccggaatcatggaagaagtggccgctcagtacaaggaagacgacagaggcatcgagcttaccgaatatgcggatacgtatatgcttggaacgaaaaaagaattcgtgccttatttgaaaaaactaatcgaagtgccgtcaaaagggctgtcgcaggcttctttggaagtgctggcgatcgtttcgtacaagcagccgatcacacgggcggaaattgaagatatccggggcgtgaagtctgagcggattctgcacagcctcgtgtcaaaagcgctgctgtgtgaggtgggccgcgccgacggtcccggccgggcgattttatacggcacgacaccggtatttcttgaacaattcggcttaaaaacattggaggagctcccgccgcttcctgaaaatgcggaggaagacgttctccaggaggaagccgatttattctttgaaaacttcaaccaaacttttgaggatattaaataataatcgtttttcatcatacgatagtagggaaaggccattgatgaatgacgcaaatgacgacgtacaagagaggaaggaaacggacggaaatgggaaattcgattgtgagggcccatactgaagaaactggtgaatttttagccgaggttgtcacgatggtcagcagctatttaaatcatacaacattgccggagatgcgggctcaaggagaggcggatgaggcatactgccgcgacgtgctcagtgtgctgaggaggatgaccgtcttttgcgaaggcgcccaggaagcctgccggcggctcttaatgcaggagccgtttcatgaggtgagagcggaaaaaacgctgtataaagtgtatcatcagtgcgtggaagaatttttcatgccaaaaaaggatacatggtacgaaaacagccgcgccgcttatacaggccaaagcgcgattgagttctaccagcaagtgccggactcgctgcggagccttctgctttcgctcagcagtgaatttctgcggatgcgggaagaattggcgcaatatgaagcatcaggctcaaatatggcatcagtcagataaaaactcttccttttgggagagtttttttatgtgaaagtgatgcaattggtattcataagtcatggacaggcgcataaacttgtacaaacccacaacaaggacgtgagcattcatgcgctttctcaaaaaagctgccgtatttcttttgacttttgttattcttttttccattacagacggcaatacggcacatgcccaaatacatgtcagcgcaaaaagcgcgattattatcgacggagcatctggcagggtgttattcgccaaggatgaacatcataagcggcggattgcaagcattacgaaaatcatgacggcggtgctggcgattgaatcaggaaagatggaagagaccgtgacggtttccccgaatgctgtaaaaacggaaggctcagccatttatcttcagccgggacaaaaagtaaagctgaaagatcttgtatacgggcttatgctgagatcaggaaatgacgccgctgcggcaatagctgaatatgtcggcggaagccttgacggttttgtatttatgatgaacaaaaaagccgagcaaatcgggatggaaaatacaaaatttcaaaatccgcacggactggacgaccatgaaaatttatattcaacggcgtatgacatggcgcttttgactaaatacgcaatgaaaatcaaggaataccggaccgtttcaggcacaaaagtgtataaggcggaaacgatggaccgggtatggaaaaataaaaacaagcttctgactgggctctaccgttacagcacaggcggaaaaacgggttacacaaaaatcgcgaaacggacgctcgtttcgacggcttcaaaagacggaacggatctcatcgcggtcaccataaatgatccggatgactgggatgaccatatgaatatgtttaattatgtctttgaacactataaaacctatgtcgtcgctaaaaaaggcggcattccgaagctgaaaaagacgttttacggaaaacacgcttttattgcccgggatgtcaaatatttattaaaagaggatgaaatcgacgatgtaaaaatccgcacaaccttaataaaaccgaaaaaagcctggaaaaaggacgcctctctcattcctgatgtcgtcggccggatgactgttatgcatgatgggaaagtgatcgccaagattcccgtctattatgaaaacgagcgccataaaaaaccgaaaaagcatttcattgagacgtttacgagcctgtttatgagcgcggcgggcggttcgtcatggtcaatttaatctgggtatgtctgacggtaatcggacttgtctttgcgatgtttaacggtaccttgcaggatgtgaatgaagctgtttttaaaggagcaaaagaagcggttacgatctcgttcggattaatgagcgtgctcgtcttctggctcggcctgatgaaaatagccgagcagtccggccttttggatatattcagcagaatgtgccgcccgtttatctctaagctgtttcccgatattccccctgatcatccggccatggggtacatcttatcaaatctcatggcaaactttttcggactgggaaatgcggcgacaccgctcggcattaaagccatggagcagatgaaaaagctgaatggaggtaagtctgaggccagccgttccatgattacctttttggcggtaaatacttcgagtattacattgataccgacaaccgtcattgccgtgcgcatggcttattcggcgaaatcaccgaccgatatcgtcgggccgaccatcttagcgactttaatttcgggaatcggcgcgattttcattgaccgctacttctggtaccgccgcaaaagaaaagggaggtaagcgaatggaaatggtgaattggctgtctttagccatgattccgattattatcgccggtatattgatatacggcacgatcaaaaaagtgccgacgtatgaatcattcgttgaaggcggaaaagaaggaattgagattgcgttttccatcattccgtatttggtcgggatgctggtggcgattaccgtattccgggcctcaggcgcgctggattttgtcatggggctgtgcaagcctttctttacagcgctcggcattcccgcagaagtcgtgccgcttgctctgatccgcccgatttcggggacggcggcgctcggcatgacgacagatctgatcgccgtgtacgggcctgattcatttatcggcagactggcctcggtcatgcagggatcgactgatacgacgctgtatgtcctgacggtgtatttcggggcggtcggcatcaaaaaaatgggggatgctttaaaggtcggtcttcttgctgatctgatcggggtggttgcatcaatcatcatagttgcgttattatttggaagcgcctgaaatcaggcgctttttatatatcagaataactctccttgaaaaagcttgtttgttcaaggggaaaaaagtaagattatacttgaggtgaacgacatggaaagactgcaaaaagttattgctcatgccggcgtggcatcacgcagaaaggcggaagagctgataaaagaaggaaaagtaaaggtgaatggaaaagtaataacagagctcggcgtaaaagtgaccggttctgatcagattgaagtaaacggattaaaggtggagcgggaagaacccgtgtactttctgctttataaaccgagaggagtgatctcagcagctgatgacgacaaagggcggaaagtggtgaccgactttttcaaagaagtgccgcagcgcatttatccgatcggcaggcttgattatgatacgagcggacttttattgctgacaaatgacggcgagtttgccaacaaactcatgcatccgaaatacgaaattgataagacgtacgtcgccaaagtgaaggggattccttccaaggaacttctgagaaagcttgagcgcggcattcagcttgaagaaggcaagacggcgccggccagagcgaaaatgctttccctggacaaaagaaagcagacgagcattattcagctgacgattcatgaaggccgaaacagacaggtccgccgcatgtttgaggcgatcggtcatgacgtgctgaaactcaaacgtgaagaatacgcatttttagatttaagaggcctgcgcacaggagacgcaagagaattgacgccgcatgaggtgaaaaggctgcgggctttagctgaacacggtaaaaacgctttctaattttcacataaccttcaaaaattacaaaacgtgtagatgatataattgaatggatttgcagacaggggaggggagcagtgtacaatgaacaaaaaacggcggcgtttattcattcggaccggcatccttctcatcttactctgcgcgctcggatataccatctataatgccgtttacacaaacggagagcgtatatctgaggggtccaaagccccgaatttcgcgctgaaagatacagagggcagactcatagaactgagtcagttaaaagggaaaggtgtttttctgaatttctggggaacgtggtgtgagccgtgcaagcaggaatttccctacatggagaatcaatacaagcattttaaagacctcggtgtcgaggtggttgcggtaaatgtcggcgaatcaaaaattgcagtacataattttatgaaaacatacggcgtcaatttcccggttgcgctcgatactgaccggcaagtgctggacgcgtacggcgtatcacctattccgacgacatttttgatcaatcccgacggaaaggtcgtgaaagtggtgaccggcacgatgacagaacgcatggttcatgactatatgaatttaattaagccggaggcgtcttcatgaaaaaggtcaaatgtgagtgcgggcacgtgaatccagccgggacggttttgtgcgagtcgtgcgggaagccgcttgatgatcaaaaatcgccgcttgccgatatgcggtacgacggcagcgcaaggcgttcgcaaacatataacaaaacaatcgtagataaggtatggaacttcttttcttccgtaaaagtcggaatatggctgatcgtcattactctggcggcgtctgctttcggcacggtttttccgcaggaagcttatctgcctccgggcgcccagccggatacatattatgaacagcagtacggcataatcggccaactgtattatttgctggggtttcatcacctgtacggctcatggtggtatatgctcctgatcgcatccattggcatatcactggtcatctgcagcctggatcgggtgattcctttgtacagggcgcttaaaaatcaaggagttcggcggaatccggtctttttgaagaggcagcgtctatacagccggacagaaaccgagctgagcggggatgcggctgatagcctcagaacacgattgaaaaaaaagcattatagagtgcgagaacaagagggaagcatcctggcggaaaaaggccgtttttcaaggtggggaccctatgtcaatcatatcggcctgatcatttttctgatcggagccatgctgagatttgtacccggtatgtatgtcgatgaaacgctctgggtccgtgaaggcgaaaccgcccagatccccggtacagacggcaaatattacttaaaaaacaaccggttcacgatgcagacatataacaaagacactgagaaaaaagtattcgccgacgccattgacagagccggaaacggcaaagtcgccaaatccttcacaacggacgcggttctgtacaagagggaaggcgacattgtattcggtgaaaagccgaagcttaaaagagtcaaagaaaacaatatccgcgtcaatgaaccgctgcgctttgactcctattctgtgtatcaggtggactataaagaaaaccagctcgatcagatggtatttcagctgatcgaccaaaaaacaaaacagtcattcggcaaactgaagatcaatcttcttgatcccgacacggactacgatcttggtaacggttacaaagtgcagattgccagttatcttcctgatttttattttaacaaagacggagaaccgagcacgaagacgaaggttcctaacaatccggcttttgtctttaaaatcacggctcccgacaagccgaaaggggagaaaagttttgttgcgattcagcagactgttgaaggttccgaaagtaacaagtacaaattaaaattcgaccatgtggaaacgaaaaacattacaggactcaccgtcagaaaagacttaaccttatgggtgcttgccgtcggcggcgcgatctttatgatcggcgtcattcaagggatgtactggcagcacagaaggatctggatcaaaacaggtgatcatgaagtgcttgtggcgggacatacgaacaaaaactggttcggtctgaaaaaggatatcgaatttgttcttagcgggaccgggattcaagagccggccgatcaaaaagaattggccaaaaatcaggcctagtgaaaaaggagtggtgtcatggcggagctgagcgcaaattttctttatgctgcctttttgatttatttaattgccgtcccggttttcggcggcgccatccggggaacaaaaggtgcgaaggacggtaagggccgctggtcggctatcggaatcacgttaaccattttcggatttctttgtcacctcggctactttattgcgagatggtcggcaagcggacatgcgcctgtcagcaatatgtttgaatttacgacgtcattcggcatgatgcttgttctcgcttttattattatttactttatttacagactgccttcattaggcatgttcacattgtctatcgcgcttttgcttatcgcatatgcaagcatgtttccgacagacatcacgccgcttattccgtcactgcagagcaattggctgtacattcacgtcacgactgcggcgctcgggcaggcgattcttgcgatcagttttgtagccggcgtcattttcctgttaaagcatgtcgaccaatccagaccgggcaaaaaaacgttctggcttgaagtcatcatgtttatactcgtgacgaccgtggcatttatcgccgtcacgtcggcattccggctggcggactacaaagcagaatttaattgggtggataaaaaagaggctaaaagcgtgatgatatatgatatgcctgcgcttgtcggcccgcatgacggagaactgcttacggaaggcgcaatgaagccgcttattgagcttccggccattttttcaggcagaaaggtcaatacggtgatctggtcgtttggcgcaggtctcgttttattcggggcgctcaggctgatattcagaaagagaatcagcgctcttataagcccgctcgtcaaaaatgtgaatctggacttggtcgatgaagtcggctaccgcgctgtttccatcggttttccggtattcacactcggcgcgcttgtgtttgcgatgatttgggcgcagcttgcatggacgcgtttttggggctgggacccgaaggaagtatgggcgctgatcacctttttattttacgcagcgtatttgcacttgcggctgtcaagaggctggcatggcgaaaagtccgcgtggcttgccgtcatcggcttcgccattattatgtttaacttaatttttgtgaatctcgtgcttgccggacttcattcgtacgcatagatgcaaaaagccgatacagttctcaagctgccgcacagtttgttaaaatgaaagtaacagaaggaaagcagggggaaaacgatggatcaaacaaatgaaactaaaatattagtagtagatgatgaagccagaattcgacgccttttaagaatgtaccttgaacgggaaaactatgtgattgaagaagcggaaaacggagacgaggccattaaaatggggctggcatcagattatgatctggtgctcttggatttaatgatgccgggaacggacggaatagaagtatgccggcagctcagagaaaaaaaagcgaccccgattatcatgctgacggcaaaaggggaagaagccaaccgcgtccaagggtttgaagcgggtacggacgattatatcgtcaagcctttcagcccgagagaagtggtgcttcgggtaaaggcgcttttaagaagggcttcccaaacatcttatctgacagccaataccccgacaaaaaatgtactcgtcttctcgcatctatccattgatcatgatgctcacagggtgactgcggacggcacggaggtgagcctgacgccgaaggaatatgaactgctgtacttcctggcgaaaacaccggacaaagtgtacgacagggaaaagcttttaaaagaagtgtggcagtatgaatttttcggagacctcagaacggtggacactcatgtcaaacggctccgtgaaaaattaaacaaagtgtctccgggagcggcgaaaaaaatcgtcaccgtctggggagtcggatacaaatttgaggtaggcgctgaatgaagttttggaaaagcgtagtaggaaagctttggtttaccattctttcactcgtgttaattgttttatttattttaacggtgctgcttctggaatttatagaaaattaccacgttgaagaagcggaaaaagatttaacgcagcttgccgataaaattgcggtcataatagaaaatcatgaagaccagccgcttgccagatccatcacgtgggaactggcggacaatttaacgagcatcgcgatcattcaggatgataagcatgtctggtattcgcccaatgacgataatcatttatcctctattacattagagcagattaaacatgaccgggatctgcacaaggcgctgacagaccgcaataaagtaagcaaacgcgcggtccccaaaaatgccggttcggataatgaacggctgatcgtcggagtgccctatgaaaaagacggcaaaaaaggcatggtctttttatcccaatcgctgcttgccgtcaaagatacgacgaaacatacgacacgctatatttttcttgcggcgggcattgccatcgtcttgacaacgtttttcgcattctttttatccagcagggtgacatatccccttcggaaaatgcgggaaggcgcccaagacttggcgaaaggaaagtttgatacaaaaattccgattctgacccaagatgaaatcggggaactggccattgcctttaatcagatgggacggcagctcaatttccatattaacgcgctgaatcaggaaaaagaacagctgtccaatattttaagcagtatggcagacggggtcatcaccattaatatcgacggcaccattttggtgaccaacccgccggccgaacgttttctgcaggcatggtattatgagcagaacatgaacattaaagaaggagacaaccttccccctgaagcaaaagagctgtttcaaaatgcagtgaacacggaaaaagagcaaatgattgaaatgacgcttcaaggaaggtcatgggttttattgatgtcgcctctttatgcggaatcacacgtccgcggcgccgtggccgtgctccgtgatatgaccgaagagcgcaggctggataaattgcgtgaagacttcattgccaatgtcagtcatgagctcagaaccccgatttctatgctgcaaggatacagtgaagcgatagtggacgacattgcaagcaccgaagaggagaaaaaagaaatcgcgcagatcatttatgatgaatctcttcgtatgggccggctcgtcaatgatttactggatttggccagaatggaatccggacatacgggtctgcgctatgaaacggtaaacctgcatgaatttctggagaagatctcccgcaaattttccggtgtagcgaaggaaaaaggcgtttcgctcacagaggacatctcggtgtctcagccggagtgtgtctttgacgaagacaaaatggaacaggtgtttaccaaccttatagataatgcgctgcgccatacggagtcaggcggaaacgttcatatcgcggctcataccgtaaaagacggactgaaaatcgatatcaaagattccggctcgggaataccggaagaggacctgccttttatttttgaacgtttttataaagcggacaaagcaagaacaagaggcagggcagggaccggactcggactcgccatcgtaaaaaatatcgtggaagcccacggcggctcaattgcggttcacagcagcatcgacaaagggacgacgtttacattttatattccgacaaaagcgcaggatgacgtctgaaattgacgaacaatcttgttccatacgaaacacccgcagaacatgcgggtgttttttgtttttttctcctttaaaaatttaagaatatgttaatataaattcccttccaaattccagtttctcgtaatatagttgtaatgtaacttttcaacgcatttttacgacaaaaaagtgaacggaggggtttcccatggaagaaacctttcagatattatacgatgcataccatcaagatttatatcaatttttattttatatggtaaaagataagtcgcaggctgaagatttgacgcaggaagtgtatatccgcgtcttgaattcctatcatacatttgaaggaagaagcagtgaaaaaacatggctgttgtccatcgcacgccatgtggcgattgactggttccgcaagcagcagacgatcagacagcgtattatgggtacgtttgattgggatacacaagatgtcagagatcagcatttgcttccggacgaactcgccgtacagcatgaaaatgtccgggaaatttataccgcgcttgatcattgcaccattgatcaaagagctgttattatcttgagatttattcagggatattccattcaggaaacagccgccgctctccgcttctcggaaagcaaagtcaaaacgacccaacacagagggctcaaaatacttcggaaacagatggagcttttgagggaggagctaatggatgatgaagtcatattggaacgaagaaagagtagaggagttgttaagacaacttccggcggttagagatcatcgttcacccgaggccatttaccggaatattgaaacgggtaaaccgtacaggaaaaaaccggcccgaagctggatcggccccgctgcagccggcatctgcgcattgtgcatcgctctgattatttctcctcacctgatgacaaacaaatctgccggtgatcttacagctgacagcggtcaagctgaaaaagccagtcagtcagctgctgtcaagccggatcagaagacgtttgtcgtttctaacgaaaacaaaaacaattacattactttggcgtttgccgattcagatacatccgccgtcattccggtcagttttgaaaaaaagaagcctgacgaatcggtttcagaggcattatctgatgcaggaaacttagaagtgcccgaatctttcctctctgtgccgaaccttttggacggtgtgcaggtaacggcggataagaaggatttgcttgtgcaggtaaacggacgtctttctatcgaatcagctgccgattctgatttattgaaaaagatgctgaaagagactttgacatggagtccttacgagcggattaaattgaaaaaggttcaaaacggagacggacaggatttttataaatcttacggcatttccgctgagatgtccgtacataaacagacaaaccgggcgtatttttcttacagcgacagtctgggacaagagtatctcatcccgtctgaacaaacctattattcagtatatcaggctattgacgggatgaagacaacagacggaggctcacagaccgcgagcattatagaagcagatgcgattgcatcggtatcggaaagggaagacggcgagcagctgcggatccaattgtccgaaaaacataaagttgaagattcgctggaaggcattttaatgatcgaagggcttttgttaaccgcgaaggaattcggttattctgaggtgctgttcacacatgcgcacgcaaagaaaatcggtaattatgatgtgacaaaaccgattgctgtgcctgccgcgcctaatccgcttccgacccattaaacgtaaaaaaacccaaaacatatgaatgttttgggttttctgttggttacggaaggtcaatcagtttaacggaaacaatatcctgaaccgaagtcagctcattgacgactttatcatctaaatgtttatcaaaagaaagcatcataatggcttctccgcctttttctttacggcccacctgcatggtagcgatattgatatcgttatcgccgaggatgcgtccgacgcgtccgattacaccagtcgtatcctggtgctggatataaacgaggtggccggcaggatttaagtcaatattaaagccgttcagttcaacgattcgttcaccgaagtgagggatatacgtagccgttaacgtaaatgtgctccggtctccggttacttttacgctgatgcagttatcatatcctgattcattggaggaaatcttctcgctgaagctgataccgcgttcttttgctacaccgcccgcgtttacttcattgaccgttgagtctacacgcggttttaagaaaccggacagcaggctttttgtaataaatgatgtttcaagtttggcgatggtgccttcatattgaatcgcaacatctttgacgggttccttcatacattgtgatacgagacttccgattttatcggcaatttggtgataaggctggatttttttgaattcatctttcgtcatcgcaggcaggttgatcgctgacatgacaggcagaccttttgcaaactgcagcacttcttcagaaacctgtgccgcgacattcagctgtgcttctttcgttgaagcgcctaagtgaggtgtggcgatcaccagcggatggtcgggaagctttgattcaactggcggttccacttcaaacacatcaagggcagcgcctgcgacatggccgctttccagcgcttccaaaagcgccgcttcatcaataatgccgcctcttgcgcagttgataagacggacgccttttttcgttttggcaatggtttctctgttaagcaatccttttgtttcctttgttaaaggcgtgtggacggtaatgatatccgcgctttcaagcacttcttcgaatgtccggctgtttacgccgattttgccggctctctcttcggttaagaaaggatcgaatacatgaactgtcataccgaacgctctggcgcgctgggcaatctcgcttccgatccggcccagaccgacaatgcctaaagtctttccgtagagctccgccccgacaaaagccgtccggttccattctcttgattttactgagatattggcttgcgggatgtgtctcattaatgaagaaatcatcgcgaatgtatgctctgccgttgaaatggtgtttccattcggcgcgtttatcacgataactccatgttttgtggcctcatcaatgtcgatgttgtctacgccgacaccggctctgccgacgatttttaaagaagtcatctttttaaacaattcttcggttacttttgtggcactgcggactaacagggcatcaaaggtatgtaattcatcttctgcatccgcgacgtttttttgaacaatttctataaagtctgattccatcagcggctttaagccgtcattgctcatcttatctgagaccaaaactcgaaacattgttagatttcctcctagtttagctgactaaatatctgataatttatcatattctcaatagagtgtcaatgtgtattgacgcagtaaaggagaaaaggaaaccgctgaatcagctgaaattgggcttccccaatattttatttaaatttgagcagttctctatacaattacaatttgatcatatataatgtgaataaattcataagatcaatcttcggggcagggtgaaattccctaccggcggtgatgagcgtcacgctctaagcccgcgagctgcttcggcggcaggatccggtgagattccggagccgacagtatagtctggatgggagaagatggaggttcagcagacgttttgatgcttatatcaaacgtttctttgccaagccttagtaagctcccgctttttaacaaaagcggtttttttattggggcgcaaaagaacctttcctcttttcgagagatttgatcgaaaaggagagagcattgtgaaagtaaaaaaattagttgtcatcagtatgcttagcagtattgcgtttgtgcttatgctgttaaatttcccgtttccggggctgccggattacttgaaaattgatttcagtgacgttcctgcaattatcgctattttggtttacgggcctgcggcggggattgcggttgaagcgattaaaaatattctgcagtatatcattcaaggaagcatggccggcgtgcctgtcgggcaggcagccaattttatcgcggggacgctgtttattctgccgacggcgtttatgtttaaaaagctcaattctgcaaaagggcttgcagtgagcctgctggccggaaccgcggcgatgaccgtgctgatgagtattttgaactatattcttatcctgcccgcgtatacttggtttttacattcaccggcattgtcaaacagccagttgaaaacggcggttgtcgcaggaattctgccgtttaacattgtaaaaggcattatcatcaccatcgtctttacgttcatctttacgaagctgaaaccttggattgaacaaaaacgcagcatccaaacacaataaaggcttaaagcgtccgctctgtgaagaacagccggacgctttttttgtttgtgctgatcggcaaaaaaataagactccggccgataacagccggagtcttattcaggacgaaaaagctcctctcacggggagggcttttttattcgtatttcagcgggtcgccttcgaacggttcatccgcaactttgattgaatcagtagggcatccttcaaatgcgtcaatcatatcttcttccagaacttccggaacttcgacgacacctttattttcgtcaagcgtaacgaacgcaatgccttcatcatcataatcataaatgtctggtgccgcagctccgcaggcgccgcatgcaatacacgtatctttatctacaattgtgtactttgccatgaataaaacctcccagattgttcgtgttggaacaaatggtttaccttatatatttttaaatataacacctattcctcttacttattgtaatgatgttagtgtcaaatttcaacagaaaaatgattgagaatgcttatcacataagggattctctttagcacttccccctaaaagatgactttaaacgtcaaatttatatgaaaatctgttaaaataaaaagaaccaaaaaacgaaacttgtcacaaaagaaatgtaggtgtgtttagattggcgataaactactttgataccgtggttctcgactgtctggacaaaatagacggcgaacggactccgagtgctgtgtttcatttattaaaaggaaaaaagtcgtctcaaaccattcaggatgccggcttatttcagatcgctaaatatttcggcatggcttcacagtgtgaacgcggcgatattgcggcttctatgcatagactcaccgagaactcatacatcacagccggaaaagaagagggaacgcggaaagtgactgcgcgcggcgttcaaaggcttgaacgggcgtttgctgagcggccttggccgaagcactgccacggcgcaaattatcaaacgcctgccgtcatcctgtggaggcggctttccctgctcattcaagtcctgtcaaacaaagagcatcaatgcagtcaatatatcccggttaccaacgatgtgcagacgctgagatgggtcaaatggttcatgcggaaaaacagagatgctaaagagctttccgtccaaatgcatgacgcgctgtttcagcttctgcaaggcgtaagtgaacggcaggcgcttatttttgtctattctttaacttcattcaacagaatcggcaaaacgaataagcagctcgctctccagctgaacgaagatgaatggtatgtgtccgtccagttttggggagcggtacattatgttattcaatcgcttccgcaatgtgcatatcccgctctgcgcgagctgttgtccgatctgcaggcggaaagcgcgctgacacagtctgccagaaaaacctttgagctgttggaaaaagggtttccgattgaacggatcgccgcggtcagaaatttaaaaaccgccacaatcgaagatcatatcgtagaaatatcattgcatcagcctgcattttttatagaacagtatctttctgaagaggaacagcgtatgataacggcatttgcaaaacagcatcaaacaaataaaattaaacggattcgcgaaggaatgcagatgcgcttcagctatttccagatcaggctggcgctggcaaagacggtgaatcagcatgactgagctgcataaagctttatccagatattttggtttgcattcctttaaaaaagggcaggaagagattatgactagcgtgctccaaaaaaaggatacgatcgccatgcttccgaccggcggggggaaatcattatgctatcagctcccgggttacatgatggacgggctggtgctgattatttcaccgcttctttcattaatggaagatcaggtgcagcagctgaaagcaaaaggagaaaagcgggttgcggcattaaacagcatgctgaattccgcagagcggcattttattctcagcaacatcagccggtataaatttctctatatgtctcctgaagccctttcttcaccttatgtactgaaccgtttgaaaaacgttccggtcagtttatttgttattgatgaggctcattgcatatcggaatggggacatgatttcaggcctgattattcgaagctcgggcctttcagacaggcactcggaaagccgcctgtattggcgctgactgcaacagcgacaaaagaaacgctcagagacgtgacggatgtgctcggacttgagcatgcggtgcgtcatctttattcagtcaaccggccgaatattctcctggcggcagaacatttggctgataatgccgaaaaaataaacaggctcacggagcttgccgaaaagcttgaaggccccggtatcatatattgtccgaccagaaaatgggcggaagagcttgcggctgagctgaatgaaaaaacgggaaagcggacggattattatcacggcggaatggatacaggggacagaatcttgatccagcagcaatttatccataaccagcttgattgcatctgctgtaccaatgcgttcggcatgggtgtggataagtcagatatccgctttgtcattcacttttatcctccccaaacggctgagggctttatgcaggaaatcggcagagcgggacgcgacggcagcccgagtgtcagtattttgctgagggcgcccggcgataccgagcttcagcagcagattattcagacagaaagcctgtctgattatgatctggaaggcattttggccgtcatacgggatgccggtacggatgatgagcgaaagcttcgggacgttctgatcaataaaggcgtccaggaaacacaggcgcgaacggccgtccatctgtatctgcaaggaaaaaccacaaaagagcagctgcaggaagaactgacataccgcgtggaaaagaagctgcgtaaaatgaaccgtttttcggcgttattagagcggaaagaatgtataagaaaagcgctgctgtcttattttgatgaatcgtatgagcctgaaggccaaaccggacaatgctgcagcagctgcggacttgatctggctccgtacgagcaaaaaggagaacggaaaaacatggaacggtttgaagattggaagctggaattaggccggattttcggttcagagtctgcgggtgagttcagctgagacggcaaagcgaattgatccagcagctctcagaccgggagattgtgatacagctgtatgccacccaattgctcatattggcggtttcagctgttatcggctttttctttttcaccgacattcacgattttttaaagctgtggcatatacgtgacgataatatcatatggtacggtgtaactcttgccgtccttgtcatttttgccgatctggcggtgatgaaatggtgtccttcgcatttatatgatgacggcggcattaatgtattgctttttaagaacaggccggttctgcacattttgtttttgacgcttctcatttcgttcagcgaagagattttgttcagaggcgttctgcagacacatatcggcttatgggccgccagcttcatttttaccgtgcttcatttcagatacttggcgaagtggcttctgtttatgatggttgcgggcatcagtcttttgctggggcttatctatgaatggaccggcaatttattcgttccggttacagcgcattttattattgatgcggtatttgcctgtcagatccgttttcaatatgttaggaggggtttgcatgacggaaatgtcaagagttgaaagaagaaaagctcagcagcgtgccgagcagcaggttgccgcggccgcggatgaacaaattgaatatcttgaagacagcctcccgacaagacaatctgtaaaagaggagcgtaaaaaaaaggaagagcaggtgaaggaaaaaaccaaaacaaaaacgccgctgttcacttttctgaccgtcctgttcattatcgtaacaatcggtgtctttttcggtcttctttatatgacgaacagcagcagatttgacccgaaggactatgaagatgtcttcatagaccacagtgaaagcgcgcctgccgttattccgaaaggcgctcagaaagatacgtcagaaaccgctcttttagaacaaccgaaaaaaaagtctgacgacaaagataagaaagaagcggctgcatctgaaaaaacaaaagaaaaaccaagtgaaaaaacacctgaaaaaacggaaacgtcctcagaaaaacaagtaaagccgacagacaccgaatacgcggagacaaaacagcagtctccgccggctgtccgtgaaaaagcggctccggctgccgcaagtgatcaagctgggactgtcccgaaaaaagtgcggaccgtacagcatactgtacagccgaaagaaacgctttaccgcatttcaatgaaatattataaaagccgggcgggcgaagaaaaaatccgcagctacaacggattaaacggaaacgacgtgtacaccggccaggttctgaacattccgctgtctgattaaaataaatgcatgttttcaccgcgtttttcatatagtgtactaatgaaaacggacaaggtgtgaagcgcatggattctttatggaagcaattagaccgatttgctgacggaccgacgaaacaaatgcttcaggcgctggtgaaacggaaattaaaatacgaaaattatgccgcacaatgccgaagatggcagtgggcgtccctcgtttgtttttccctgatgtgcatactgctgatgtttaaaagctttaatgccccccaagcctctccgcagctgattctgcaggaaatattaggccatacggtttatttgtgctggattatggcttccgcttttgcgtattgcacttcttattattttaaaaaaaaggaagaaaaagctgagggtgaatttcataaactgagatgtgaaattatccaaaaaagcacggatttatggccccagcctgaaaaatggagggcgagagaatctgtttttcacttgatgaaacatcggtatgatatcaatctttattttgaaagcaaataaaatgaggcgttttccggaaaggatagaaacgtctttttttgtttgtccgtctaatgtaagacaatgacagaatggagagtgcgtttatgaagctaacagcgggaattctcggctcattggcgggagcggctgcggttatggcggccgtcatgtacaaaacggcaaacggcagccatctgaaaacacatacatttacgcttgataaaatgaaagggatgaagccgctcaccatcttctttatatctgacgtgcaccgccgtttaattgatgaaaagcttctccgcgaagcggcagtttataagccggatgccgttttgctcggcggtgatttggcggagggcggagttccttacgccagaattgaagaaaacatcaaacgtctgacggctctcgcgcctgtcatttatgtgtggggaaataatgattacgaggtcagccagcaaaaattgctctcacttttacgggcatacaaagtgattccgctgagaaatgaatcggttcagtttgcttataaaggggaaaccgttacgatctgcggggtggatgatatcaggatgatgatggatgattacgaagctgcaatcagatatacggatgctgataaagtaaaccttctgctttgccataaccccgacatccatgagcagatgagggagtcagacgggattgacgctgtgttcagcggccatacgcatggcggccaaatccgtttcggccggttcgggccgtacgaattgggcggggcgggaacggtaaaaaaagcgcattatctgatcagcaacggctacgggacgacaaaagttccgctgaggctcggggcgaagccggagacgcatatgattacgctgtgcgggccggatgagccgttttcctgaaacaaatccggccgcggtgataaaaaacggcattctgcttgtcttcccgctgtacacggtgtaaactgataacaaattaagaacctatgactcatttattcatatactgtgttatatgatttgtgtgcaagaagaggcaggagggaacattatgcggcttgagcgtctgaactataataagattaaaatctttttaaccctcgacgatctgactgatcggggactgacaaaagaagacctctggaaggactcgtttaaagtccaccagttatttaaagatatgatgaatgaagcaaatacagagctcggctttgaagcgaatggtccgatcgcggtggaagtatattctcttcaggcacaaggtatggttgtgattgtaacgaaaaatcatgacgcggacgcagaagatgacgaatatgacgatgattatatcgagatgcaggtcaaacttgacgaaagcccggatattatttatcagttccattcgtttgaagatatcattcagcttgccggaagccttcaccgcatcgggattaccggcggcaccgtctaccattatgagaaccaatactatgtaagccttgaagacctcggctcccgttccgccgaaggtgtcatcgcggtgctggctgaatacggacacccggcgacaattacgatttacaggctccatgagtacggaaaactcatcatggacggcaatgctgtggaaaccatccagaaacatttttcataaaaaagatttgaaacggcagctgttttcagcggccgtctttttttaagcgaaataatggaaaaatcattgtctttcttctatgcacggagatattgaaggtgtatactagtcactgaaagggagcatgagagaaacagaagattttaggaggttaactcaaatggcagccgatcgattcaccggtcataatgaagaagacaaacatgatgtattaaaatcaacccaaaccgtaatacataaagctctggaaaaattggggtatccagaagaagtgtatgaactgctgaaagagccgctcagattattaacggttaaaattcctgttcggatggatgacgggtctgtgaaaatatttacaggctatcgtgcgcagcacaatgattccgtaggtccgacaaaaggcggcattcgttttcacccgaatgtaactgaaaaagaggtgaaagcactttccatctggatgagtttaaaatgcggaattattgatcttccttatggcggtggtaaaggcggaattgtttgtgatccgagaaatatgtcattcagagagcttgaaaggctgagcaggggatatgtaagagcaatcagtcagattgtcggaccgactaaagacgtcccggcacctgacgtatttacaaactcacagattatggcttggatgatggatgaatattcaagaattgatgaatttaactcacccggctttattacgggaaaaccgcttgtactcggcggatcccacggcagggaatcagcgacggcaaaaggcgtcaccatctgcataaaagaagcggctaagaaaaaaggtctcgatattcagaacgcgcgtgtcgtcgtacaaggtttcggaaatgcgggcagctatctggccaagtttatgcatgacgccggcgcgaaagttgtcggaatttctgacgcgtacggaggcctttacgatccggacggtcttgatattgattatctgcttgaccgcagagacagcttcggaacggtgacgaagcttttcaatgacaccattacgaatcaggagctgcttgagctggactgtgatatacttgtcccggcggcgatcgaaaaccaaattacagaagaaaacgctgaccgcatcaaagcgaaaatcgtggtagaagcggcaaacggaccgacgacactggaaggaacgaaaatcctgacagacaaaggaacgctgctggttcccgatgttctggcgagcgccggcggtgtaacggtttcttatttcgaatgggttcaaaacaaccagggcttctactggagtgaagaagaagtcgaggaaaaactggaaaatatgatgataaaatcgtttaataatatttatgaaatgtcccaaaaccgccggattgacatgaggcttgcggcttacatggtcggcgtgcggaaaatggctgaggcttcgcgtttcagaggctggatataaaccaatcgtttgcataaacaaaaaaaatctcctatgataatataggagattttttatatgagtggaaacttatgatggaaatgccaatcgcaggagttgaaggacatgacagaagaaaaagcaattataataggcggaggtccttgcggattatcggcggctatacatctgaagcaaattggcgtgaacgcgcttgtgatcgaaaaagggaatgtcgtaaacagcatttataactatccgacgcaccaaacttttttcagttcaagtgaaaaattggagatcggcgatgtcgcctttattacggaaaacagaaaaccggtccgaatacaggctctctcttactacagagaggttgtcagaagaaaagagctgcgcgtaaacgcctttgaaacggtggagcgcgtaacgaaacaggaagacggccgttttcttgtagaaacgtcaaaagaccgctacctcactccgttttgtatcattgcgacaggatattatgatcatccgaattatatgaacataccgggtgaagggcttcctaaggtatttcattactttaaagaaggccatccttattttgataaagatgttgctgtgatcggcgggaaaaactcaagtgtggacgcggctttggaactcgtgaagtccggtgcgcgcgtcacggtgctctacagaggacatgagtattccccgagcatcaagccgtggattctgcctgagtttgaggcccttgtcagaaacggcacaatccggatggaattcggcgcttgtcttgaagaagtgacggaagatgaaatcattttccgctccggccgaaatgagacggtccggctgaaaaacgatttcgtatttgccatgacgggataccatcccgatcacggtttcctcgaaaaaatcggtgtgcagattgatgctgaatcaggccggccgtttttccgggaagaaacgatggaaacaaatgttgacggtgtttttatcgccggagtcattgcggctggaaataacgccaatgaaatttttatcgagaacggccgttttcacggcggcttgatcgcaaacgaaatatcaaaacggctgggtgcagagagcatatgatcattcatatgctcttttttaaaaaattgaaagatgtaaaaatatgaacaacatggtaccatagatataggaatataaaggaaagaggttgcctgatgtttgcaatcatctctgcaggaattgctcccggcattgcgctgttaagctatttttatttaaaagatcagtatgacaatgaacctgtacatatggtgctgaggtctttttttctcggggttgtccttgtgtttccgaccatgtttatccaatatgttcttgaaaaagagcatgtggggggaggaagctttttcgtttcgtttttgtcttcgggatttttggaagaatcggtgaaatggttcgttctgatgatcagtgtgtacccgcatgctcattttgatgagcattatgacggaatcgtttacggggccagtgtgtctttaggctttgccacgcttgaaaatattctgtatttattcggccacggcgttgagcatgcttttataagagcgcttctgccggtctcctgccatgcgctgatcggagtgattatgggattttatctcggaaaagcccgcttttcgcagaaaaaagcccgtgtcaaatggcttgtgatttcgctggccgtgccttcatgtctgcacggttcttacgattttattcttaccgccctcaatcattgggtatattatatgctgccgtttatgctgtttttatggtggttcgggctgcgaaaggcaaaaaaagcacgctccgtcaatatgatccaagtgtgaagaaaccgcgcatcgcgtgcggtttctttttttatgccttgatgagggataagaaggaaacggtgtataaaaatatccgcgtgacagacaatacgggtacactttaaattttgcagtaggaggcttgaagagatgaagtgcaaaggagcctttatggcatgtctcattctattttctttcgccgccgctttcttcgatcatcatgaaacggttcatgcgttttcaaatcaagtgattcaaagaggcgcgacgggtgatgatgttatagaattgcaggcccgtcttcaatataacggattttataacgggaaaatcgatggtgtttacggctggaccacatactgggccgtgagaaattttcaggagaaattcggcatgaagccggttgacggcctcgtcggggcgaaaaccaaacaggtgctgatttcaaaatcaaaatattaccgtgaatatgtaatggagcagatccaaaaagggaatacgttcactcattatggcaacgtcccattggaaaaccaaacaaaaccgagagccggagcgcagaagcctgcggaaacgaataagcctgctcaaaagccgcaaaacaatacaggcggtcagtcaaatcaaaagcaaaatacgacagcggctaatatgcctggcggtttctcaaacaacgacatcaatcttctggcgcaggctgtgtacggggaagcgcgcggtgagccgtttgaaggacaggttgccattgccgcggttattttaaaccgtattaaaagcccgttatttccgaatacggtggccggcgtcattttcgaaccgctcgcgtttaccgccgttgccgacggccaaatatacatgcagccgaatgaaagagcaaaagaagcggttcttgatgcgattaacggatgggacccttctgaaaacgcgctttattatttcaatcctgatacggcgacaagcaaatggatttggggacgtccgcagattaaaagaatcggaaagcacattttctgtgagtaaaagtacgcaaaatgaggtgttaacatgattagaggaatcattatcgctgttctcggtgtcgcgatcgccgcaaccggatactggggatataaagagcatcaggaaaaagatgcggtccttctgcacgcggaaaataattatcagagggcttttcatgaactgacgtaccatgttgatcagcttcacgacaaaatcgggacgacgcttgcgatgaacagtaaaaaatctctgtctccggcgctcattgatgtatggagaattacatctgaagcgcataacaatgtgagccagctgcccctgactctcatgccttttaataagacggaggagtttttatccaatataggagatttcagctataaaacatccgtccgggatttagaccaaaaaccgcttgataagaaagaatatacaacactgaacagcctgtacaaacaggcggagaacattcaaaaccagcttcgcagcgttcagcatctcgtcatgagcaaaaatttacggtggatggatgttgaaatggcgctcgcctctgacaaaaaacaaagcgataatacgatcgtcgacagctttaaaacagtcgaaaaaaatgtaggcgctttttctgaagacagcatcagccccacatttacgggagcaaatacagaacgaaaaggttttacgcatctgaaaggaaaacaaattacggaaaaagaagcggtaaaaatcgcacaacggtttgcgcctgatcataattattccattaaagtggtcaaaagcggccggaagacgaatcgcgatgtatacagtatccgcatgaatgacgcggatcacaaatcttttatctatatggatattacccaaaaagggggacatcctgtctatttgattcaaaaacgggccgtgaagaaacaaaagatcagcctcaatgaagcatctaaccgggctgtcgcgtttttaaagaaaaacggatatgaaacaaaaggtctcgaaattgatgaaagcgcgcaatataataacatcggcgtcttttcttttattcccgtggagaaaaacgtccgcatttatccggaagccatccgaatgaaagtggcgctggatgatggtgaagtcgtcggtttttccgcgcgtgattacctggcggcgcaccgcacgagaacgattccggctcccgctttgtcagctgatgaagcgaaagcgaagctgaataaaaatgttgaagtgcgggagacccggcaggcgctgatcacgaatgaactcggtcaggaagtgctttgctacgaaatgctcgggacgatcgggaaagacacgtatcaaatgttcattaatgcggacgacggaaaagaggaaaaaatagaaaaattaaaaagcgcagagcctatatataaagacctataaaaataaaggaggaaaggactaaaagtcttttcctttttttcattacatgctttaataaaagcataaataatgaaagagtgaaggccatgatagctgtcggagattatatttggattgaatacatagagaacaatgagcccaaaaaagcgaggagtaaagcagtaagcgttgaaaacggcgaactccacatctcatatcccgtcgatctggattcgggacggacggtctttttgcataaaggattggaaataacagcggaatttatggggaatggccaagtaccgtatcaatttaaaagcataattaaaggaaagaaaaaagaacccatcccgatgatcggattggacatcccccctcaggaggaaatgaagcggattcaaagacgccgatacgtccgtgcagacgcagtattggatgtatccgtcaaattggaagcgaaaaaaaccgcttttcaaacggtttcctctaatatcagcgccggcggaatcgctgttgtgatgcctgagcatatttccgcggaaccaggtgaaaagctgtatgtctcattttctcttcccggcaaggaaaatggggcggatataacggccgaggctcttacccagcggattttttatgatgaaaaggcggataaacaaaaaatgacgcttgaatttacagaaatcggccccgcagcacagcagcttttactccaatattgtatgcgcgcgcagctgcagcagagaagaaacagtctgtcggaataaacagcagcgcacttttccatactaatcctaatggaggtgcgcgtgtatgaaaacatttgaacgtctgctggtcaaattggtctgcattcagcttataattttgggcgcggtgcagtttttgcttcattatcagcctattgaaccttatatttcgaaagctgtgaaatatgagggagttgataaaatggagaaaaaagaatggattgaaacggtaaagcggtaaatcagctcaattttttcgccccttttccggcagttcatgatacaatccatagaggagtaaagagcaaggagagagattatggacaagaaattatcaattgcgatcgacgggccggccgctgccggaaaaagcaccgttgctaaaatagtagctgagaaaaaatcatatgtgtacattgatacaggggcgatgtatcgtgccattacatatacggcactcaagcagaatgccgatttaaccgatgaagccgcgcttacagagcttttgaagcgtacggaaattgagcttgtatccgctccggaaagacaaatcgttctcgtaaacggagaagatgtgacagaagaaatccgaaaagacgaagtcagcaaccaagtatccatcgccgccaagcataaaggcgtcagagaagaaatggtcaaaagacagcagcagctcggacaaaaaggcggtgtcgtcatggacggccgtgatatcggtactcacgtgctgcctgatgccgaagtgaaaatttttctgctcgcgtccgtagaggaaagagcgaagcgccgatatgaagagaataagaaaaaaggctatgacgtgaattacgagacgctcattgaagaaattgccagacgcgacaaactcgattcagagagggaagtttccccgctgcgcaaagcggaagacgcgattgaaatcgatacgacgtcactcagcattgccgaagtcgcaggaaaaattctggagatcgtcgaacagaaatcacgttaacttcgggcggagcgctttttaatttttttcaaaagacaagatgttattgcttgacaaaccagtccttttattagaagttaatactaataaaactttttattgatcattcaaaatcttttttggatgattctttaatacatattcggctgaaaagcggacattcacatgttcagctttcaaaccgtattaattaagctgtgtaggtttggaccaaggaggttattcaaatgacagaggaaatgaatcaaattgatgttcaagtgccagaggttggagatgtagtaaaagggattgtgacaaaggtagaggacaagcatgtagatgtcgaaattgtcaatgtcaaacagtccggaatcattccaatcagtgaattatcaagtcttcatgtagagaaagcatcggatgtcgtaaaagttgacgacgagcttgacctgaaagtaacaaaagtggaagacgatgctttgattttatctaaacgtgccgttgatgctgaccgcgcttgggaagaccttgaaaaaaaattcgacacaaaagaagtgtttgaagctgaagtgaaagatgtggtgaaaggcggtctcgtcgttgatatcggcgttcgcggcttcattcccgcatcacttgtcgaagctcatttcgtcgaggatttcactgactataaagggaaaaccctctctcttatcgtcgttgaactcgaccgtgataaaaaccgggtgattctgtcacaccgggctgtagtggaaaaagagcagacagccaaaaagcatgattttctccaaacgcttgaggttggaagcgtgcttgaaggaaaagtgcagcgtctgactgatttcggcgcatttgtcgacatcggcggaattgacgggcttgttcatatttcgcagctgtctcattcacacgtcgaaaaaccgtctgacgtggtggaagaaggtcaggacgtaaaagtgaaagtgctgtccgtagaccgcgataacgagcgtatttctttatctattaaagaaacgctgccgggaccttggagccagatcggcgaaaaggtaaaacagggagatgtgcttgaaggaaaagtgcagcgccttgtaagcttcggcgccttcgttgaaattcttccgggcgtggaaggacttgtgcacatttcgcaaatttccaataaacatatcggaacgccgcatgaagtgcttgaagaaggacagactgttaaagtgaaagtgcttgacgtgaacgaaagcgaagagcgcatttccttaagcatgcgtgagcttgaagaagcgccgaaagccgatcaggaggacttccgtcaataccaggcgaaagaagagccgagcaccggcttccagcttggcgatttaatcggagacaagcttaataaattaaaataaattggtgataaaacgtgacacgagcagaacgaaaaagagaacatataaatcatgcgctgtctaccggccaaaaccgggaaacggggcttgatgatattacgtttgttcatgtcagcctaccgaacctagcattggaaaaagtggatatatcaacgaaaatcggcggactcacaagcagttcgccgatttttatcaatgcgatgacaggcggcggcggacagcttacatacgaaattaacagatcgctggcaagagccgcgcgcaaagccggcatgccgctggctgtcggttcgcaaatgtcggctttaaaagatccctccgaacggtattcttacgagatcgtcagaaaagagaatccggacgggctgatatttgccaatttaggcagcgaggcggatgccgagcaggcaaaaagagcaattgatatgattcaagcggatgccctccagattcatttaaatgtgattcaggagatcgtcatgccggagggagacagaagctttaccggcgctctcggccgtattgagcggattgcggcggaagcgggagttcccgtttttgtcaaagaagtcggcttcggaatgagcagggagtcggcacggcagttatttgatgccggtgcggcagcagttgatgccggcggatacggcggtacaaatttctctaagattgaaaatatgcgcagagagaaggcgcttcaattttttaatacatggggaatttccactgccgcaagcttagcggaaatccactcgctctccgctgatcaatcaattatcgcatccggcgggctgcaaagtgccctggatgtcgccaaatcgattgccctcggcgcttctggcgcgggaatggcaggcactttcctgaaagctctcacctccaaaggagaagaggggctgtttgacgagatgacggtgcttttacaagagctgaaaatgattatgaccgccctcggatgccaatcggttgcccaattgcaaaaggcgcctttggtcataaaaggtgacacacatcactggctttctgaacggggaattgacacatcccgtttcagcagacgttaaaaggcatgcgaacccgcatgcctttctctgttttttacgattttctttttcggaattcaccgttttgttcaaggctcgtcgctcctttatggtgaattgaatcatcgcgatcagattccacccggcgggaggctttcagttttttctcctgtctgtcttttcccatttttatccgctcctttcaggcataattggtttaaaaaatgcgttcccgctccatactggtcagaggaggagcgattatggaaccgttttattattactggtcaatgtggtttttatggatacttgcgacttttatttttgccaaaacaaaaagccgtttttacgtatcagtctttattttgactaatatgatggcaagcatacatcagataacggcttattttacgctgaacgcggcatatgtcatgttttttgctgcggcatttgtttatgcgggaagcctcggcatgcataaacggctccgtcatattgtgattcatctgacggcggctgcggcgtacggctttatttttctttttgcattatatgaccctgtttggtttatcataaaacctgaatgggcagcggttatactgcttaccgttattacgctttctgttgaggggcggttccctgagaggctttgtctttttgttctcggcatgtgccagggggagttattgtatgctgcggtcatccgcaacattgcgggggcagcagccgtcggtgattataaatggctatcaggctgttcggcgggagtgattcttctcgtcgggctgactacatatgaacagcttgcggcgcgcatcagccaaaaaagcaaaaagcagggcaaaggagcgacaaaaatgtcttgaaaacagacggagactgttacatgaatacgaaacattttgaagaatacattgtgatctcagtgaaaactgatataataaatgagttaagcccttctgtttgaagggttcttttcatagcgaagatgattattaataaccggttgaacaattttttgtgaaaatgtaagcggctggattgaaaggaagggtactatgggtaaacctgtcgtagccattgtcggaagaccgaatgtgggaaaatccacaatctttaaccggattgcgggtgaaagaatttcaatagtagaagatacccccggagtgacgcgggaccggatatacagttcggcggaatggctgaattatgattttaacctgattgatacgggcggaattgatatcggagacgagccgtttctgacacagatccgccagcaggctgaaatcgccatggacgaggctgatgtgatcatctttatggtgaacggccgcgaaggtgtgacgtctgcggatgaagaagtggcaaaaatactgtaccggacgaaaaaaccggtcgtattagccgttaataaattagataataccgaaatgagagcgaacatttatgacttttatgcgctcggctttggagaaccgtatccgatttcggggacacacggtttaggattgggagatttgctcgatgcttgtgccgagcattttaaaaacattccggagacgaagtacagtgatgatgtcgttcaattctgcctgatcggccgcccgaatgtcggaaaatcatcccttgtcaatgcgatgctcggcgaagagcgggttatcgtgagcaacgtagccggaacgactagagacgctgtggatacggcgttcacttacaatcagcaggaatttgtaatcgttgacacggcgggaatgagaaaaaagggtaaagtatatgaaacaacagaaaaatacagtgtgctgcgggcgttaaaagccattgaccgctcagacgtcgtcggcgttgtgctgaatgcagaagaaggcatccttgagcaggacaagcggatcgccggatacgcccatgaagccgggaaagccgtcgtcattatcgtaaacaaatgggatgccgttgataaggacgagcgcacgatgaaagaatttgaacagaatattcgggagcatttccaatttctcgattatgcgccggtgctgtttatgtcggcactgacgacaaagcggattcatacactcatgcctgcgattattaaagcgagtgaaaaccactctctccgtgtgcagacaaatgtcttaaatgatgtcatcatggatgcggtcgccatgaatccgactccgacgcacaacggctcccgtctgaaaatttattatgcgactcaagtcgctgttaagccgccgagcttcgttgtttttgtcaacgatccggaactgatgcatttttcttatgaacgctttttagaaaaccgaatccgggacgctttcggatttgaaggtacgccaattaaaatatttgcaagagcaagaaaataaaaaggtgtgatacagagatgaaaaaagtggcaatgcttggagcgggaagctggggcactgcactttctttagtgctggctgataacggacatcaagtcatgatgtggggacaccgtgccgaattgatcgatcaaatcaacgaactgcatgaaaacaaagattacctgccgggtgtggagctatcaagttctatcatcgggacagccgatttaagcgaggctttaaaaggagctgacttcatcattgtggcagtaccgacaaaagccattcgggaagtgctgaaaaaggctctgccgtatatcccgaaacaatcgatttttgttcatgtcagcaagggaattgagccggattcgcttctccgcatttcagaattaatggaggaggagctgcctgaggagtacagaaaagacatcgtcgtgctttcagggccgagccacgctgaggaagtcggattaagacacccgacgactgttacatcatcttcaaaaaatatcaaggctgcagaagcggttcaggatttattcatgaaccagcatttccgcgtctatacaaatcccgatatgatcggtgttgaaatagggggagcgttaaaaaatatcatcgctcttgcagcggggattacagacggattgggatacggagataatgcaaaagcggccttaatcacccgaggtcttgctgaaatcgccagactcggcacaaagatgggcggaaatccgctcaccttttccggcctgaccggcgtaggcgatttaatcgtgacgtgtacaagcgttcattcccgaaactggcgcgccggcaacctgctcggcaaaggatataagctggaagctgtcctggataagatggggatggttgttgaaggcgtgcggacgacgaaagctgcgtatcagctgtctcaaaaatatcaggtgaaaatgccgatcacagaagcgcttcaccaagtattatttaatgggcagaaggtagaaacggccgtagaatccttaatggccagagtgaaaacccatgagatggaagacttggtcaacacattcgaaaaccgggtgaagtgacaataacatgccgtcagcatattctgaagtgacgaaagtccaaaacgcagaactctccggctgaaatcgcttaaaacatttgctgatttaggcagaagaggatgcagacgtacgcatctacgcatactatagcatcgaagtccaagagagtgtatctcagacgtacaggtgaatatagtcaacttgactgaagcaaagtccccctctttgcttcagtttttttgttttttcaatagatggaaaacctgttgatcttttcaacatttgtatattaaaatgaaatataacgcttacaatgatgggacggggggcacgaacgtgagtgtggcattgatgaaaatgtggtttgcgcttggtgctatgggattaatgtttgttgcggtcgcctttatttatgtcagcaggtacaaagtgaaaaacaaactgataaaagcagcggtttcttcactcgcttatgcctgcatggtcatctcgggattgatcgtgttaatggtcgttttcagcgggcctgtcaatgaataaagccaaaagggggcgcggaatgcataagttaaaaatggccgtcataacggcaatggcggtgcttctgctgtcgggctgtctgtaccctgaagcaaaaaaaactgaaaataaagtatcttacaaacatcagcttcagcaggtgcaagcggcagtggatgaatttaaaaaggcgaacggcggacttctgccgattcagacaaaagatatgaaaacaccgctctatcaaaaatatccgatagattttaagcggctcgcgcccagatacatagaggagccgccggcctcagcttatgaaagcggaggaatgtaccaatacgtgcttgtcgatgtggaaaataagcctaccgtcaagctggtcgatctccaaatggcggaagcaatccgcgacatgaagctgcgtgtcaaaatgtatcaggaaaagcatacatatcctccctatgaggacgctgtttcaaaaggcctgttcactttaaataaaaaaaagctcggcatgaaagactctccttcagtcaaaagtccggtttcaggcacgtctctgccgcttttaatcggcgctgacggagaaatctatgccgactatcgcgtcgatctcgcccgctgcctgaaggaaaacaaaaagaaaatcaaaccgggcgcggaaattcaggatattttatggaaagagactcctttcgtcccggccttttcagtcacttacaccgtaaatgaaaaacaggaacccgtttttttagaaagtcaaacgaaacaggaatgaacctttttcccgcgcatacaaatagggagaaaggtttttttgattttgatagaaaagactgcctgaaaattttctaaagatgtcatattgaaataggacaacgtcatacacatatagtgtcctgtatttgattggagaatggtgaatgaaaaatgataaggataggaagtccgggaggggatcacttggaaaaggtcgatattttcaaggatatcgctgaacgaacaggaggcgatatatacttaggagtcgttggcgctgtccgtacagggaaatctacattcattaaaaaatttatggagcttgtggtgctcccgaatatcagcaatgaggccgaccgagcgcgggcgcaggatgagcttccgcaaagcgcagcaggaaaaacgataatgaccacagaaccaaaatttgtcccgaatcaagccatgtccgttcatgtcgcggaaggacttgatgtcaacatccgtcttgtggattgtgtgggatatacggttcccggggcgaagggatatgaggatgaaaacggtccgagaatgatcaatacaccttggtatgaagaaccgattccctttcatgaggctgcggaaatcggtacgagaaaagtcatccaggaacactccacaatcggggtcgtcattacgacagacggctcaatcggcgatattgcgcggggcgattacgtggaagcggaagaaagagtcatcgacgagctgaaggaagtcggcaaaccgtttattatggtcatcaactcggtaaaaccgtaccacccggaaacagaagcgctcagagctgaattaagcgcgaaatatgatattcccgtcctcgccatgagtgttgaaagcatgcgggaaacagatgtgttaagcgtcctcagagaagcgctttacgagttccctgtgctggaagtcaatgtcaaccttccgagctgggtcatggtgctgaaagaaaatcattggctcagagagagctaccaggaatcagtgaaagaaaccgtaaaagatattaaacgcctgcgcgatgtcgaccgggttgtcggccacttcagtgaatttgagtttattgaaagcgccggattggccggaatcgaacttggccagggtgtcgcagaaattgatttgtatgcgccggatcatttatatgaccagattttaaaagaagtggtcggcgttgaaatccgcgggaaagaccacctgcttgaattaatgcaggacttcgcccacgcgaaaaaagaatatgatcaggtatcagatgcgctgaaaatggtgaaacagaccggctacggcattgccgccccggccttaaccgatatgagccttgatgaaccggaaatcatcaggcagggatcaaggttcggagtaaggctgaaagcggtcgctccgtccattcatatgatcaaagtggatgtggaaagtgaattcgcaccgatcatcgggacagaaaaacaaagtgaagagcttgtccgctacttaatgcaggactttgaagatgatccgctttctatctggaattccgatattttcggcagatcattgagctctatcgtaagagaaggaatctccgcaaaactgtcactcatgccggaaaatgcgagatacaaactgaaagaaacgctggagagaattattaacgaaggctcaggcggcctgatcgccattattttgtaagctgaaggacctcttcctgaaacggggggtctttttttattctttttagatactggaaatcaatcaaggattaggaggaaaaaagcaaaaaaaggaatatttgttcggtaaaacacgtgaaaaccttgacgagcaagggattgaggctttaaaatgcttgatatggctttttatatgtgttactctacatacagaaaatcttcactttgttggacaaacattcctcaaagtgtctgttttcttatgaaaagccgtttacttgtctgttcttccctgctttgattttttatcagacaggtttagaatcaggctgaactgtgaagaaatgataataaactgctgatttgatacccttttgggaggaggtgaaaggcatgaacaagacagaactaatcaatgcggttgctgaagcaagcgaattgtctaaaaaagacgctacaaaagcagttgattctgtttttgatacgattttagatgcacttaaaaacggtgataaaatccaactgatcggtttcggtaactttgaggtgcgcgagcgttctgcacgtaaaggacgtaacccgcaaacgggtgaagaaatcgaaatccctgcaagcaaggtacctgctttcaaaccaggtaaagctcttaaagacgctgttgcaggaaaataattgtgaatatagatcgtgtatgcatctgatacatacactttgtttcttcacagaaaagccccttgataaaggggcttttcatatttaagcagccccggtcaccgggcaggactttcgttttgcttttggcgcggcaaatgtgctagaatcgaaattaaatgtattcaatggtggaggacacagacaatgaaagaagttaataaagaacagattgaacaggcggttcgccagattttagaggcgattggagaagatccggaccgggaagggcttttagatacgccgaaacgcgtggcaaaaatgtacgcggaagtattctcgggattaaatgaagacccgaaagaacactttaaaaccgttttcggagaagagcatgaggagcttgttcttgtaaaagatatcgcgtttcattccatgtgtgaacatcaccttgttcctttttacggaaaagcgcatattgcctacattccgcgcggcggcaaagtgacgggcctgagtaaattggcgcgggcggtggaagccgtctcaaaacgcccgcagctgcaggagcgcattacttcaacgattgcagaaagcatcgtagagaccttagatccccacggcgtcatggttgtcgtcgaagctgagcatatgtgcatgacgatgaggggcgtaagaaagcctggcgcaaaaacagtgacttccgctgtaagaggtatttttaaagatgacgcagcggcgcgttccgaagtgttagaacatattaaacgtgcggattaataatgatagagggtgcagatatgaattcaaagcattcaagtgattttgtcgtcattaaagcggtcgaggacggcgtgaacgtcatcggtttaacgagaggtacggatacgaaatttcaccattccgaaaaactggacaaaggcgaagtgattatcgctcagtttactgagcatacctctgccatcaaagtgagaggcaacgccctcatccagaccgcttacggagaaatgaacagcgaaaaaaaataagccggctgtttcccgcttttgccaattgcccgcaaacggcgggagaatacagccaatttcttttttttatgctataatgatacctgcgtataataatgacgagtaaatctcatacatattagaataaatgtgaatttggggacaagggtgatatttttgcaagacatctacggaactttaacgaatctaaatacgaaattaaaacaaaagctgtctcatccttatttagcgaaacatatttccgcgcctaaaatcgatgaggataagcttcttctttttcacgctttgtttgaagaggcggacattaagaacaacgacagagaaaattacatagtaactgcgatgcttgtccaaagcgcccttgatacccacgatgaagtgacaacagccagagcgttaaagcgagacgaaaataaaaaccggcagctcaccgtgcttgccggcgactatttcagcggactgtattattcgcttttatctgaaatgaaggatatctatatgattcggacgctcgctacggcaattaaagaaatcaatgagcataaaatccgtctgtacgatcggtctgtcaatgacttgaatcaattgatcgaaagcatggcgattgtggaagcggccctgtttcacagagtgtcagaccactttaatcttccgcgctggaaagagctggcgagtgatttttttgtatataagcggctgatgaacggcaatgctatatttctcgatgtcatcggcaatattgtaaagtcagggaaatcaaaggctgacataatggaagatagcttccgaaaggcaaagcaaagcattgaaacgctgctgccgctcaattcaccaatccaaaacctcatgctgaaccggctcaaagcgatcagccaggacaaaacatatcatcagaaagtggaagaagggtaatcaacatgcaggagtcaaaagaacagcgcgtacacggcgtgtttgaaaaaatctataaaaattatgaccaaatgaactctgttatcagttttcagcagcataaaaaatggcgcgataaaacgatgcagatcatgaatgtaaaagaaggcgcaaaagcgcttgatgtctgctgcggaacggctgactggacgattgccctcgcagaagcagccggaaaaagcggcgaaatcaaaggactggatttcagcaaaaatatgctgagcatcggcgagaaaaaagtgaaagagggcggttacagccaaattgagcttttgcacggaaatgcgatggagcttcccttcgctgatgattcttttgattttgtcaccatcggcttcgggctgcggaacgttcccgactatctgaccgtgctgaaagaaatgcggcgggtcgtcaaaccgggcgggcaggttgtatgtctggaaacatcccagccggaaatgttcggattcagacaggcatattttctatattttaaatacatcatgcctttcttcggaaaaatgtttgcgaagagctataaagaatattcttggcttcaagaatcggcaagagaatttcccggtatgaaagagcttgcgcgtctgtttgaagaagcgggcctgacgaatgtcaaataccattcgtttaccggcggagtggccgctacgcatatcggttggaaatgatgaatatacagatgtttgggtgaatgatatgaaatttaaaatggcctattcttttttaaatgacgatattgatgtgatcgaaagggaacttgagcaaacggtgcggtcagactatcccttgctgagtgaagccgggctccatctgctccaggcgggaggcaagcggatccgccctgttttcgtattgctttccggcatgttcggcgactatgacattaataaaataaaatatgttgcggtgacgctggaaatgattcatatggcgtccctcgtgcatgacgacgtcattgatgacgccgagctgcggaggggaaaaccgaccatcaaagccaagtgggacaaccgtatcgccatgtataccggtgattatatgcttgcgggctcacttgagatgatgacgagattggatgagccgaaagcccaccggatcctgtccaaaaccatcgtagaagtatgcctcggagaaattgaacagatcagagataaatacaatatggaacaaaacctcagaacctatttgcgccgcatcaaacggaaaacggctcttctcattgccgtcagctgccagctcggcgccatcgcttcgggagctgatgagaagattcacaaagcattatattggttcggctattacgtgggcatgtcctaccagattattgacgacattcttgatttcacttcaacggaagaggaactgggaaagccggtcggaggggatctgctgcaaggaaatgtcactctgcccgttttgtacgcgctccgtcagcctgaattgaaaaatcagctgaaattaattaacagtgaaacaacacaggagcagctcgcccccattattgaaaatattaaacgcacagacgcaattgaaaaatcaatggccgtcagtgacaggtacttaaaaaaagcgtttgaaaaactgaatacactgccgagaggacgggcgcgctcatcattggccgccatcgccaaatatatcggcaaacggaaattttaaattccttttacgaacaagatgtgaacattctccgccctggattgattaattgtcagaaagatgttacgatttcggtgtgcaacttgaaagcctatacataatgatggggtggagaatcttatggaaaaaacttttatcatggtaaaaccggacggcgtacagcgccagctgatcggagagattttatccagatttgagcgtaagggcttacaattggcaggagccaagctaatgcaagtttcagaacagatggctgaaaaccattatgctgaacataaagggaagccgtttttcggcgagcttgtggaattcattacatcaggacccgtatttgcaatggtatgggaaggggaaaatgtagtagagatcacaagacagctgatcggaaaaacgaacccgaaagatgcactgccgggcacgatccgcggtgactacggcatgtttgtcggcaaaaatatcattcacggttcagactccttagaaagcgccgagcgggaaattgacattttcttcaaacgggaagagcttgtaccgtatcaaaaattaatggccgactgggtgtactaagccgtcagcctttctttttctcttgttatgaaaaggtttacatattttaagaaagacagaggctgcgctgccctgtcttttcatttctcacaaatcagcctgcgggctgatttttttattgaaatcgtacaaattagaaagaaaacaggctatactaggacaaaagacagcgagattgggagagaagcaatggagccttacgaaatttttatcaccaagtggaaacaaataaccggcgttgatttatctttatacaaagaagcacagatgaaaaggcggctgacgtccctttatgaaaaaaagggattcaaagattttcaggaatttgccgccgctttggagaaagacaagcttttattaaatgaaacattggacaggatgacgatcaatgtttctgaattttaccgaaattataaacggtgggaagttcttgaaacctcaattcttccgttaataaagcataacaaaccgttaaaaatatggagtgcggcctgttcaacgggggaggaaccctatactttggctatgattctcagtcagcaggcgggtttggccggatttgatatattggcgacagatattgatgaaaaggcgcttggcaaagccaagcggggcatctatcaggaacgctcgctgcaagaggtgccggcttccgtgaaaagccgttatttcaccaagcaggctgacaacagttatcaagtaaaacaagagattcaaaaaaacatccggtttaagcggcacaatctgctcgccgacagctatgaacaggattttgatctgatcgtctgccgcaacgtctttatttattttactgaaaaagcaaaagaagagctgtatgtaaaaatggcgggcagcctgaaaaagaacggaattctgtttgtcggaagcacagagcagattttcagcccggaaaaattcggccttgagagcactgatacatttttttatcaaaaaagatagaagacatttaatgaaaacttgtggtatagttttacttaaaagcgttaatgcgatgaagggagaagaaagaaatgagatacttaacagccggagaatcacacggcccgcagctgacgacaattatagaaggtgtgcctgcggggctttatataactgaagaagacattaattttgagcttgccagacgtcaaaaagggcacggccgcggacgccgcatgcagattgaaacggacagggcgaagatcacaagcggcgtgcggcatgcccggacactcggttcacccatcgcgctcgttgtagagaataaagattggactcactggacaaaaatcatgggcgccgcaccgattacagaagaagaagaaagtgaaatgaaacgtcagatttcaagaccgagaccgggacacgcagatttgaacggggctattaagtataatcaccgtgatatgagaaatgtgttagaacgatcttccgcgcgtgagacaacggttcgcgtggctgccggagccgtcgctaaaaagattttagcggagcttggcattaaagtcgccggacacgtcctgcaaattggcagcgtaaaagcagagaaaaccgattacacatccattgaggatctcaaacgggtaacggaagaatcaccggtgagatgctacgatgaagaagcaggccgtcaaatgatggcagccattgatgaagcgaaggcaaacggcgactcgatcggcggaatcgttgaagtgatcgtcgaaggtatgcctgtcggtgtcggaagttatgtccactatgaccgtaagctggacagcaagctcgctgcagccgttctgtcgattaacgcgtttaaaggcgtagagttcggcatcggttttgaagcggccggcaaaaacggcagtgaagttcatgatgaaatcgtatgggatgaagagaaaggctatacacgcgccacaaacaggctcggaggattagaaggcggtatgacgacgggaatgccgattgtcgtccgcggcgtcatgaaaccgatccctactttgtataagccgctgaaaagcgtcgacattgaaactaaagaaccatttacagcgagcattgaacgttcagacagctgcgcggttccggcagcaagtgtagtggctgaagctgcagtggcctgggaaatcgcaaatgccgtcgtagaacaattcgggcttgaccagatcgaccgcattaaagaaaatgttgaaaacatgaaaaaactatcgagggaattctgatgaaagagcttgaggttcggacagcttcctccgcatatcccgtgtatatcggtgaaggcataaggaaacaggccgctgctcttttgtcttcactgaacaggccgctgacaaagatccttctcgtcatcgatgctgaagttgaccggctttacggcgatgagatgttccggcttttaaacgaaacatggcccgtgaaaaaagtaatcgttccaagcggagaagaagcgaagtctctaaaagagtatgaacggattcaaacggaagcgatcgctttccatatggaccgctcctcatgtatgatcgccttcggaggcggcgtgacgggtgatttgaccggcttttgcgcagcgacttttatgcgaggaattgatttcattcaaatgccgacgacactgcttgcccatgacagcgcggtcggcggcaaggtggccgtcaaccataaactcggaaagaacttaatcggcgcgttttatcagccgaaagcggtgatttacgatacggagcttctgaaaaccctgccggaacaagagctgagatcgggcatggctgaagtgatcaaacacgcgtttatcgccgatcatgcttttttagaaaaacttctcacgtttgacacgttgcaaggactgacaagcgctgagctgaatgaaatgatttataaaggaatttcaatcaaatcggccgtcgtgcgtgaggacgaaaaggaagagggcataagagcttttctgaatttcggccatacgctcggccatgccgttgaggcggaatacggctacggccggattactcatggagatgcggtcgccctcggcatgcagtttgccctttacgtgagtgaacaggttgcgggttgcaagatgaacaggaaagaactcacacaatggctgattgggctcggctacccgggaagtatcagacaagatattgaaacgccggttctctccgcccggatgatgaatgataaaaaaacgcgcggaggcatgacacagttcatcgtgttaaaggaattaggggaagcgcgggactgcatgctttcaaaagatgagctcgaaaatttgctgaacaaatggcgaatggaggaaacagcatgatgatacgcggcattcgcggagcaacaacggtggaacaagacaccgaacaagaaattttagaaaaaacacagcagctgcttgaaaaaatcattgaacaaaatggatgcaagccggaagacgttgtacagatcctgttatccgccacgcctgatatccattccgtatttccggcaaaagcggtccgccgcctttccgggtggcagtacgtcccggtgacgtgcatgcaggaaatggatgtcaccggcgctctgcaaaagtgtatccgtgtcctgatgacggttcagacggatacgcctcaggatgaaatcaagcatgtctatttagaaaaagccgttgtgttaaggccggatttatcattgacaaaaaatactgacatgtaatacgataaacaaagcttagaaatacacaagagtgtgtatagagctggtaagtaagatattgaacagttgagtttagaatagggtagcagagaatgagtttagctgagctgagataaacacgtttttattctgcccaaaagaagcctttcttttgggtttatttcttatacgcaagactcctctcactcttcatctcattctccttaccgtaaggaggagaatcatgaatttacaatcggatgtttctttatttttaaaggacagtctgacacaccgcaccattccaatcgcagagacttttacggtcgacacgatcacacccattcagatggttgaaaaactggacagaaacattacgtatcttttagaaagcaaggatgagtcgtcaagctggtcgagatactcttttatcggcctcgatccttttatcacgattaaagagagtcatcacacattcactgccgctgatccaaacgggcatacgctgtttgaagccggagaattaaaagccgtgcttgattggatgaatgaaagcttccgcattaaaacacccgagcttgatatcccgttttcgggaggggccgtcggttatctgagctatgacatgatccctttgattgagcctaccgtgccgagccacgcgaaagaaacagatttcgaaaaatgcatgctgtttgtctgccggaaaatcatcgcgtacgaccacgaaacgaaacaagtgcatttcattcaatatgcggcgcttaacggccgggagacggaggaagaaaagcgggccgtttttaaagaaaattgcgcggagcttcgtaagcttatcggtattttgacagaaccgaaagatatgaaagagccgtttttttctaaagaaacatttgaaacgccaagttttgccgatatgacatctaattatacgaaagaagagtttatggccggcgtcaataaactgaaagaatatataaaagccggagacatttttcaaggggtgctttcgcaaaagtttgacattccggtatccagacattcatttgagctgtacagggtgctccgcatcgtcaatccttcaccttatatgtactatatcaaactgcctgacagagacattgtcggaagttcgcctgaacgtctgatccgcgtggatgacagacacctggaaattcatccgattgccggaacgagaagaaggggcgccggaaaagaagaggacgatcgcctcaaaaaagagctgatgaatgacgaaaaagagaaagctgaacattatatgctcgtcgatcttgcgcgcaatgacatcggcagagttgcggagtacggttccgtagccgttccggaattcacaaaggtcgtttctttttcacatgtgatgcacatcatctctgttgtaaccggccgtttaaaacagggcgtccatccggttgatgcgctgatgtcggcattcccggcaggaacactctcgggcgctccgaaaatccgcgcgatgcagcttttaaatgaattagaaccgacttccagagaaacctacggcggatgtatcgcttatatcggatttgacgggtcaattgattcgtgtatcaccatccgcaccatgagtgtcaaaaacggtacggcgtcggtgcaggcgggcgcgggaatagtcgctgattccgtcccggaagccgaatatgaagagagctgtaacaaagcgggggcgcttttaaaaacgattcaaatcgcagaagacatcttttctggcagggaggagaagacggatgaacaaatttctgcaatcgtgcgttaatggccgcacgctgaaaaccggagaagccgaaaagctgatggagatgatgatgaacggggccatgtcgcagtctgagatcggggggattttatcggtattagcccaccggggtgaaacggcggaggagcttgccggatttgtaaaagtgatgcgggcgcgggcacagacggcgggtggcttggcggatgtcgttgatacgtgcggaacaggcggagacgggatttctacgtttaacatatccacggcagcggcgattacagcttctgccgccggagctaaagttgccaagcacggaaatcgctccgtttcgtctaaaagcggcagcgcggatgtgctggaaaagctgggggtttccattcaagccactccagaaagcgtcaaacgcagcattgaaatgaaacaaatggggtttttgtttgcgccgctgtttcattcgtcaatgaagcacgtcgccgccgcaagaaaagagcttggcttccgaaccgtatttaatctgctgggcccgctcagcaacccgctgcaggtgaagcggcaggtgatcggcgtctattcatttgataaagcgcgcctgatggcaagcgctttggaacaatttgatgtcagacacgtcatgcttgtgtcggcgcgtgacggattagatgaactgtccatcacagcaccgacagatatcattgagctgaaaaacggtgaacgtctggaatattccgtttcacctgaacaattcggttttgcagaaggttcattgaaggatattcaagtgagttcatcggaagaaagcgcgcttctcattcagaatatttttgcaaatagagctccgtcatccgctctgcatattaccgccttaaatgcgggcgcggccatttatacggcaggtcttgcaaacgatctgaaagaaggaacgaaaacagccttagaagccattcaaaacggagatgccaaaaggcagctcgaacgtctgaaacagaaagaggaagaaatgtatgcttgatcaaatcattctgcagaaaaaagaagaaatcaaatccatcgtgctgccggaaacctgtcaaattgaacggagatcctttaaagaagcgctcctgaacccgaaccgttttatcgggctgattgccgaagtgaaaaaagcttcgccgtctaaaggattgattaaagagcattttgttccggaaacgattgcggcggattatgaagcggctaaagccgacgccctttcggttctcacggatacccgtttttttcaggggagaaatcaatttctgacagatgttaaacaaaccgtgtctcttcccgtgctgagaaaagattttattattgattcccttcaggtggaggaatcgttcaggatcggcgccgatgccattttgctgatcggggaagcgctggaacctccaaagcttcatgagctttatctggaagcccgcgggaagggcatggacgttctcgttgaagtccatgatgaaactgtgcttgaacggattttacaagtgtttcagccggacattctcggcataaacaaccgggacttaaaaacgttccgtacttctgtttcgcaaacggaaaaaatagcgcagcttgtgccggacggctgcctgctggtcagcgaaagcggcatcggttctttggctgacctgcaattcgtcaacaagcacggggcgcaggctgtattggtcggagaatccttaatgagagaggattcgcagcaaaaggcgatccgcggactgttcggagagtgacgatatgaaaaagcctgagttaaagtactgcggaatacgatcgaagcgtgattatgaacttgcggcagcttcagaagcggattatctgggatttatttttgccgcaagcaaacggagagtaacgccggatgaggtccggaaatggaaagagcaggtccggacagacaagaaacatgtcggagtatttgtaaatgaaacgatagaaaacatcgcgcaaatcgcatctgatctggcacttgacgtcatccagcttcacggtgatgaatcgcctgaggatgcccttcgcctccgtccgcttgtgcgctcggaaatatggaaagcgctccatcacggggaagggacgctccgtcagatggctcaatttacacctgctgtcgacggctatgtcattgattcttcagtgacaggaatgagaggcgggacgggaatcgcgttttcatgggcccgtgtccccttgtaccgaaagcaggctcaaaatgcaagcaagcgctgttttattgcgggcggtgttaatcctgaaacgattaccggcttactgagaacgcgtccgtgcggtatagatcttgccagcggaattgaaaaaaacggacacaaggatcaaacactgatccggcttttagaagaaaggatgaaccactatgtatccatatccaaatgaaatcggaagatacggcgaattcggcggcaaatttgtccctgaaacattgatgcggccccttgaggaaatcgaaacggctttcacagaattaaaaaatgatcctgtttttcatgccgaatataaaaaactattgtttgattactccggaagaccgactgcattaacgttcgcagacagggtgtcagagtatttgggaggggcgaaaatctatctgaaaagagaagatttaaaccataccggctctcataaaattaacaacgcgttaggccagattctgcttgctaaaaagatgggcaaaacgaaaatcatcgccgaaaccggtgcgggacagcacggtgtggctgccgcgacagccgccgcaaaattcggttttaaatgtacggtttttatgggtgaagaagacgttgcgcgccagtcgctgaacgtattccggatgaaactgctcggcgcggaagtggtgccggtcacaagcggcaacggcacgctgaaagatgcgacgaatgaggcaatcaggtattgggtccagcattgtgaagatcatttctatcttatcggttctgtagtgggtccgcacccatatccgtatatcgttcgcgaatttcagaaaatcatcggcgaggaagcgaaagaacagctccgccgggttgaaggaacgctcccggacaaggttgttgcatgtgtcggcggcggaagcaatgcgatgggcatatttcaggcctttttagacgaagacattgagctgatcggcgccgaggcggccggaaaagggattgatacgccgctgcatgcggcaacgatcgcaaaagggacgctcggggtgattcacggatcaatgacctatttaatacaagatgaatacgggcagattatcgaaccgtattccatttcagcaggccttgattacccggggatcggccctgagcacgcctatctgcacaaaagcggccgtgtaacgtacgaaagcgtgacagacgatgaagcgattgccgcgttacgtctgctttctgaaacagaaggtattcttccggctattgaatctgcccacgccctggcaaaagcgtttgaaatggcaaaggacatggataaagacaaaatcattctcgtcagtttgtcgggaagaggagataaagatgttcatacgctgatgaatgttttggaaaacggggtggagacacatgtttaatctgcgagattctgaaaaattgtttatcccttttatcacagcgggcgatccgcttcctgacatttctgttgaactggcaatatcattacagaatgcaggcgcttctgcccttgaaatcggcgttccttacacagatccgcttgcggacggacccgtcatacaacgggcttcaaaacgggctctggaaaacggaatgaatatcgtaaaagccattgaacttggcggcaaaatgaaaaaaaacggcgttcatattccaattatcctctttacgtattataatcctgtgttacaattagaaaaagaatactttttcgctttactgcgggaaaacgacatagacggcctgcttgtacccgaccttccattagaggaaagcgcccttttgcaaatgacatgcaaaaaggagaacatcgcttatatctcgctggttgcgccgacaagtgaagaccgtttgaaaataattactgaacaggcctgcggctttgtgtattgtgtatcctctttaggagtgacgggcgtacgcagcgaattcgatccgtctgtatactctttcatccgtaaggtgaaagaattcagctctgttccggtggcggtcggttttggcatttcaaaccgcaaacaggttgacgggatgaatgaaatatctgacggtgtcgttgtcggcagcgcgcttgtcaaaaaagttgaagagcttaaaacaaagcttgtgaatcccggcacaagagctgatgcgcttcttgaatttgaagaatacgcgaagacgttcggacgactgtacagtgtaaaatgaggtgactggatttgcagattaaagaacagctgcggcagctgaaaccgtatcagccgggcaaaccaatagaagaagtgaaaatggaatacgggcttgaaaaagtagtaaaactcgcttctaacgaaaatccgttcggctgttcacaggccgcaaaagatgcgctgcatcaggagattgagcagcttgcgctgtatcccgacggttacagtgccgctttgagaacgcggctcagtgagcatctgcaggtcagtgaatcttcgatcattttcggcaacggctctgatgagctagtgcagattatctgccgttctttattaaatgatcaggcaaacacgattaccgccgccccgactttcccgcaatacagacacaatgcggtgattgaaggcgctgaggtgcgcgaggtgccgctccgcagtgacggcgctcatgatttagaccggatgctggaagcaattgacggcgagacgaaagtcatatgggtatgcaaccccaataatccgacggggacatatacttctgagcaagagttaattgcctttttaaacagagttcccgagcatatactcgttgtacttgatgaagcgtactacgagtatgttacggcggacgattaccctgaaagcatcccgcttttaaagcaatatccgaatgtcatgatcctccgcaccttctctaaagcgtacggacttgccgcgctgcgtgtcggatacggcattgcggacgaagcgctgatccgccagattgaaccggcgagagagccgttcaatacgagcagaatcggtcaggcttcggcactggcagcgcttgacgaccacacatttattcaggaatgcgtcgagaaaaataaagcgggccttaagcagtattatgattttgcggaaactcacggattaacttgttatccttcacaaaccaactttgtgctcattgattttaaccgtccggcggatgaactgttccaagccctgttggaaaaaggatatatcgtccgttcaggacaggcgctcggatttccgacagcgttaaggattacggtcggtacgaaagagcagaatgaggaaattctcacaatcttagctgaaatattataagaggtgatcaagcatcacctctttgctctattaaaatagttgaaaaaggaaatgagtgaaatgaaggatactatattgcttgcggggatcgggctgatcggcggatcgatcgcattggccatcaaaaaggagcatccgcataaacggattatcggtgtggatatttcggaagaacagctcactgccgcgctgaagctcggaattattgacgagcgggccggctcattgacggaaggggcgcagcaagcgtctgttgtcattatcgccacgcctgtcgcccaaacgctgaaaatgctcgatatgctggccgcatcagacatcacccatgaactcctgattacggatgtgggcagcacgaaacagaaagtcgtcagctacgccgacaaagtgcttccggctcattatcaatttgtcggcggccatccgatggcggggtctcataaatccggggccgctgccgccaaagaatttttattcgaaaatgcgttttacattttaacacccggaaaatcaacttctaaagagtcagtaacgcatctgaaggagcttttgaaagcggcaaacgcccactttgtggagatgactcccgaggagcatgacggcgtaacgagcgtcatcagccatttccctcatatcgttgctgcaagcctcgtccatcaggctcatcattctgaagaaaattatccgtttttgaagcgtttcgcagccggcggttttcgggacatcaccagaatcgcctcaagcagtccggcgatgtggagagacatacttcttcataacaaagataaactgcttgaccgcttcaaagaatggaaacgggagattgacacgatcgaatcttatgtagaaaatgaagatgcggacagcctgttcggatattttaaaaaagcgaaagattatcgcgacggcctgccgctccgtcaaaaaggagcgatcccgtccttttatgacctttatgtcgatgttcccgatcatccgggggtcatttcggaaattacggcgatactggcagaagaaaaaatcagtatcaccaacatccgcattatcgaaacaagagaagatattaacggaattctcagaatcagtttccagactgatgatgaccggaagcgcgcggaaacctgcattcaatcccgcgccaaatatgacacattttacgctgactgaggtggaaaacattgaaaagagaaaaagtgacgtctttaaacggtgaaattcatattccgggggataaatccatctcccaccgttctgttatgttcggagcgcttgcggaaggaacgacaacggtaaaaaactttttgcccggagccgattgtctgagcaccattgcctgcttcagaaaaatgggtgtctccattgaacaaaacggaagtgatgtaacgatatacggaaagggcattgacgcactttgtgagcctgacagccttcttgatgtcggaaattccggcacgaccatccgcctgatgctcggcattttagccggacgcccatttcacagtacggtagcgggtgacgaaagtattgcaaagcgcccgatgaagagggtgacggagcctttaaaacagatgggagccgcgattgacggaagagcggacggagggtttacgcctttatccgtaagaggcggacaattgaaaggcatagattacgtctcccctgttgcaagcgcgcagatcaaatctgccgtgctgcttgccggattgcaggctgaagggacgacgaccgtcactgagcctcataaatcaagagaccatacggaacggatgctgaacgcttttggcgccgagcttgcggaaacggagacgagcgcttccgtaacgggcggtcagaagcttcggggagccgatattttcgtgcccggcgatatttcttcagcggcctttttcctcgcggcaggcgctgtcgttcccggaagccggattgtgctgaaaaacgtcggcctgaacccgacacgcacgggaatgattgatgtcttaaagcaaatgggggcttcacttgaagtgattccttcagaagcggacagtgcggagccttacggagacctggttattgaaacctcagctctgaaagcggcagaaatcggcggagaaatcattccccgtttaattgacgagatcccgattatcgcccttttggcaacgcaggctgaaggcacaactgtcattaaagacgctgcggagctgaaggtgaaggaaacgaaccggatcgacaccgtcgtatcagagctccggaaaatcggcgcagacattgaaccgactgaagacggcatgaaaatacacggcaaaaaaacgcttgcgggcggagccgatgtgtcaagccacggcgaccaccgcatcggcatgatgctcggtatcgcttcatgcctgacagaagagccgatcgacatccgtgatacagaggcgatccatgtctcatatccgacattctttgagcatttagatcaattagccaaaaaagcctgaagacgattcttcgggcttttttcttcatgtgtcataaaatcttgggctttgacatagcttgtcttaaacagaaaactaaaagaaagggggaatgcgttttcgttacagaaacagccggaacaaattgcgctgtttgcgtataaagatgccgtccccttttttgccgttttcctcttaaccattttctgataaactataatgccgggtgaagcatcttatttgcgggcaggccctgtctgaattatgataagaataacccgaataaaaacccttttcatttggttgatgaggtataggaaaagaaaggaccggtctgatttgaatacattgattcaagaagccataaaattagttgaagcaggtgaaaccgaaaagggactcaaagcgctttcaaaagctgaaacagagcttcatgacgaagacaaagccattgcagcccagctctactatgaatggggaaacgccgaaaaagcgttagcgctgatcagtgatctgcatgacctctatccgggtgagtctgagctgacgaatttttacgccgaattgttaatagatattgatgaagaagaaaaagctcttgaggtgctggagacgatttctccggaagacccgtcttacgcggaaagcctccttttaatggctgatctgtatcagatgcagggcttatttgaagtaagtgagcaaaagctgttacaggcgaaagcgatgttacaagatgaacctgttattgatttcgctctgggggaattatacttcactcagggatcatatgcaaaagccgttccttactatgaagagacggcaaaagaacggcacgaaatcggcggcgtaaacgttcatcagaggctggctgagtcattgagcgcggcgggtgaatttgaggaagcgatttcatggtatgaaaaagcggcggcagaacatacagaaccgaatacgattttcgggtacgggttcacagcctatcaggcgggaatggtcaaaacagccatcaagcagctgtctgatttaaaagggcttgatccttcctattcatcgctttatatgccgcttgcaaaaagctacgaggcagaaggcatgtatgaagatgcattaaaaaccgctaaagaaggtattacttacgatgaatacaataaagagctttttctctatgcggcgaaaatggcgttaaagctcggcagcgaagaggaaggcaaaaagcttcttcaggaagcgctggcgctcgatccgggttacgtggaagcgctccatacgcttttagccgtctatcataaagaagaaagctttgaagagattattgatctgattcaggaagtccgcggctacggagaagaagatccgaaatacaattggtatttggcgggggcctatacaggcctggagcaatacgctgaagcgaaaaaaagcttcgaagctgcgtatctccattatcaggatgatcgggatttcttatatgaatacgctcacttcttattggaagagggtctccagaaagaagcgctgccgcttttaaaacaagtgctttcaatggatggaacaaacgaagagcttgaagaaacaatcttacggatagaggatgaatttttaagataagcaggattttggaccatgcttgctgaatgtataagtgatgtcagattatacgatcgatagaggagggaattacatgcagacccctgtttctgtcaatgaaaaaaaggattttatccgttggtttttaaatcattatcagcttaaacgccgggagtgcgtctggattttaaattatttaatgagtcatgattcattaatggaaaaagtccattttgtagaacaagccgaattttgcccgagaggcattatcatgtctactcattgcgttgatgaggtgccgtttaggttttacaaagaaaatgtcatgactacggacgcggaaaaatcttttcacgacatccggttaaataaacagcaggatttatttatccagctgaatttccgttcggcctacagctcaccggaatatgccgctgttcttgaatcaaatccgcatctgccgaaagacctgtttgaaaataaacaggatcaggggatggctgaaaaaatattagaacatgccatttccactttccagcgggaaaagctgcttaaagatatcgacgaggcgctggaccgccacgacaaagaaacatttgaaaagctttcccgccaattgaatcagctcacataaatgacagccttgcagaatatgcaaggcttgttgcgtaaagaggaggaacgagacatgagatggagggccgctgatgccgatgcctatttacaatctgcggattacattgataccgctgtcattccgttaatttccataacgtcttcaggaggcttaaaagaggccgttgaacagggggaaagcacccaattgctttctgaagagcttgagcgccaattgaagggacgggtatatttattcccctcttatacatatgttgatatagaccaatcacaaatcgccctgcttcaaaaactcaaagaagaggtgatgaccaacttcaggcacgccttgttcctgacggcagacgaaaaatggaaggattctgaaatagggtctgatgtcatatacatacctgccgttccgtttgaacatatgaaagactctttaaagagaaaaattgcggatgacaagtgcggagaaattttgaacgttttgttacagaagtggaacaattcttaaaaactccaggcatcctgcaaaacacccgttttgcctctgttgaccttgctgaaagattcatatattatgagggtgtcaaatctcagaattattttctattttagttaatttttggtcaatctttagggggggaagagatgggcggaaaacaagatatatcaagaagacaatttttaaactatgcgctcaccggcgtggggggatttatggccgccagtgcgcttatgcctatggtccgttttgcgctggatccggtattaaaaccgacgggagatcaaaaaatggtgcaggttgtcagtgtggatgagctgacgaaggagccgaagcggtttgactttaaaattcatcaagtcgacgcctggtacgaatcggaagaatccaggtcagcctgggtttacaagcatggggatgaaattatagcgctttctccgatctgcaagcatttgggctgcaccgtaaactggaacaatgatcctaaaaatccgaacaaattcttttgtccctgccattacgggctgtatgaaaaagacggcacgaacgttccgggcacgccgccgctcgcgcctcttgaccgttatgagcaaaaagtaaaggacggctttttgtatcttggaaaagcaaagcctaggggggaagggtgacatgctgaataaaatttatgactgggtggatgaacgtctcgatattacgccgatgtggcgggatatcgccgaccatgaagtgccggaacatgtaaatcccgctcaccatttctcggcttttgtctattgtttcggcggtttgacgttttttgtaaccgttatccaagtgctctccgggatgtttttaacgatgtattatgtgccggatataaaaaacgcgtgggaatctgtgtattatttgcagaatgaagtcgctttcgggcagattgtaaggggtatgcaccattggggcgcaagtttagtcatcgtgatgatgtttttacatacgctgcgggttttctttcagggagcttataaaaagcctcgggaattgaactggatcgtcggtgttctgatcttttttgtgatgctcggtctcggatttacagggtatttgcttccgtgggatatgaaggcgctgtttgcgacaaaggtaggtcttcagattgccgaggcgacgccattgatcggagcgcaggtgaaaactcttcttgccggccaccacgatattgtcggcgctcaaacgctgacgagattttttgcgattcacgtattttttctccctgccgctttgtttgcgctcatgggcgcccactttgttatgatccgcaagcagggaatttcaggaccgctttaatacaaatctgatataaaagggaggggatgacatgcaccgggggaaaggaatgaagtttgtaggagattcaaggataccggctgaaaaaaaaccgaatataccgaaagactattcagagtatcctggaaagacagaggcgttttggccgaactttctgctgaaagaatggatggtcggggccgttttcctcgtcgggtttctcgttttaacgattgtgcacgagccgcctttggaacgggtggcggatcctacggatacagggtatattccgctgccggattggtattttctatttttataccagcttttaaaatatgaatatgccgcagggagctacaccgttatcggagcgatgattataccggggcttgccttcgggtcgctgcttttggctccgtttctcgacagggggtctgaaagaaggccgtggaagcgtccggttgctgtcgggatgatgcttttggcgctttgcgctacggtctttttaacgtggcagtcagtcgcgacacatgactgggcaaaggcggaggagcaagggaaaattaaaaaagaagccgccattgatactgaatcagacggttataaggtatttaaagaacaaggctgtatttcctgtcacggggataatcttcaagggggaggcgccggtccgtccctggtcgataacgggctgagcccggaagaaattaaaaaaatcgccgtcaaagggaaagggcagatgccagccggtatttttaaagggaatgacaaacagcttgatcagctggcgaagttcatttctgaaacgacagcgaaataacgtattgtgaagtagacaacagcaggatatactttatgaaaagagctgaccggatgtcagctttttttgcatgatacatactttttacggactgagagttgatggtatgaggtggatttcttatcttttagggttgcgcggcatgcttctgcttgttcttgccgttaattttatcggtacggtgtacggctattattggtatgtgccgcagcttgcggacacgccgttccgatttctgatatttgtgcctgacagcccgacggcgacgtttttcttcctgtttgtgcttctggcatttctcatgggaagaaacgcgccgctgtttgaagcgctggctcttgtaacccttgtaaaatacgggctgtgggcggtcggaatgaatgtctttgtgctggtcaaaatggggcagatgccttgggaagggtatatgctgattgcttcacattttgccatggccgttcaaggcgttttatacagcccgtattttcggttccggttatggcatcttgccgttgctgctgtttggacgcttcataatgacgtcattgattatcttttcggcatgatgccccgctactcaatgctcaatgactatatgcaagagatcggctatgctacattctggctgagcatattttcactcggccttgcatactatttggtgatttctaaaagacggataaagcttgacttacactgatagaatcttggtctaaccttgtcccgctcctcatattctgtaaagagaaggagtgggagggacctctatgaaacgaaagctgacgatctgtcttttacttgctcttatgtgtttcatcacaactgccaaagctgaagatgagggcggtctcaaggaactgaacgacctttcggataccgttttccaaatgacgcggcattcgcagtatgatgaggctctgcaagtgcttggctactttaagaaaaaaatgacacacgtaaactcactgagcggcgccgaagtcaggcaggtgactctgggcttcaatgatttagtgcgcgtcctgaaacaggcagacgcctcagataccgaaaaaatccgggcagccgcccagttcaggttggtaatggatgcgatggaagaccactccgatccgctgtggggttcgcttgaaagaccgattatggcgacattcagcgccttaaaagaagatgtcagcggaaacggaagtggaaatttcaatgaaaagtggaatgaatttatatcattatatgatttaatttatcccagcctgacaatggatgtgtcggccggccagcttgatacggtggcgaaacatatcgaggtgattgagcaggaagggtttcagcagatgacaaaaggaacaaagcttgagcgtctgacactcctgcagcaggatttaaagcgggtttttgacaaggtggagcgggatgacgctgacccttcgctgctctgggtcattctgacaacaggcggtatcattattactgcgctgacatatgtcggctaccgaaaatacagagcggaaaaaaagaaagagaaaaagcgtgagtatcctaagtctaaataaacacaaattgctgtaaaggagctaagtcagtgaaaaaactcatccagcaattggcttcaaaacacctcccgcagccgatcagaggcagaaaaggggcgactgacgaaggaccgcgaaacctcgcgcgtgacttccagaatcctgacatgctcgttccgccttcaacggatgcaggaacggttcaaaacttgaaattctcattttctgatacgcatatgaggcttgaagacggcggatggtccagagaggtgacggtcagggaactgccggtatccaaaaacatcgcggcggtgaacatgaggctgaaaccgggagctgtgcgggagcttcattggcataaagaagccgaatggggatatgtgattaacggaggagtacgtttaactgcggtcgatcaaaatgggcggaattttattgataacgtaagtgaaggggacctgtggtattttccttccggcattcctcattccattcaaggattagagcagggaagtgagtttttgctcgtctttgatgacggctctttttcagaaaacagcaccttttcagtaacggactggtttgcccacaccccgcgcagcgtgctggaggcgaacttcggtgttccgggctatgagctggcttacattcacaagaaagagcgttatatgttccagttggaaccgccgcccccaattgagcgggcagcagtctcttccccggaaggccccgttttagagccgttcagctacaagctttcccggcaggagcctcttgttaccagcgggggaagagtaaagattgtcgattcaaaaacgtttaaggtgtcaaaaacgattgctgcagctcttgtggaggtcgaacccggaggcatgagagaattgcattggcacccgaatacggacgagtggcagtattacctttcaggagaagcgaaaatgacggtgtttgcggcggagggaagagcgcggacatttaactatcaagcgggtgacgtaggatatgttcctgttgcaatgggacattatgttcagaataccggtgacaccgtgcttcgctttctggaaatcttcaaaagcgaccgtttcgaagacgtctccttaaaccaatggctggcactgacgccgcagcgcttcgtcgagcagacgctcaatgtcagtccggcattcgcccgccgattgaaaaagaaaaaatcaccggttgtcaaatggaaacacgaacagtaaaggcggcaaaagccgcctttttattatcgtctgatcggatttttattttcatcaagcgtaaatccttcgccgagcacatcatggacgtcgcttactgcaacaaaggcgtgcgggtcaacggaagtgatgacgcttttcaaaagcacaatttcgtttttcggaacgacgcagtaaagaacgtccctgtcttcttttgtatatgatccctgtccttttaaaacggtgacgccgcgctccatctcttcaatgattttttgctggatcaaatcgtttttcgaagaaataatcgttgccccttttgcggcatagccgccttcctgtataaaatcaatcaatctcgcagcgacaaaaacggctacaagcgtgtacatcgcttccttgtaagaaagatacgtaaacaaagaaagcagaatgacacaggcgtcaaaggcaaacatcgtccggcccatcgggattccgaaaaatttgttgatcagccgagcgatgatatcgaccccgcccgtcgtgccgccgtatttaaaaataatgccgagacccgcgccgataaaaacaccggcgaacaaggcggccagcgctaaatcatgcgacagcggcatatgaatttcgtagcgctgaaaaacactcagaaaaacggaaagagagacggtgccgatcagggtatagacaaacatcgtccggccgagcatacgccagccgatgaaaaagataggaatgtttaataccaggttggaaatagaagggctgatgtggaataacgcatataaaagcagcgtaatgccggtaaatccgccttccgccaaattgttctgcatattaaagtgaaccagtccgaatgaaaaaacagcggcgccgattaaaataaagcaaatgtttttgattctgatttctccaagcattgcatcaaaccccttttccttccataagattgcgtaaatattatagtggatacaaaagaaaacagcaaactgccgtttttaacatttgtcaaatgtacttgaattagctaacatggaagagatgacaggaggtattcgcacagtgagtgacaaaacgatgaaagacttacaagctgaggtcgatgaatatatcggccaattcaaagaaggctatttcagcccgcttgccatgatggcccgtctcacggaagaactgggcgaacttgcaagggaagtcaaccattattatggggaaaagccgaagaaaacgacggaaaatgagaaaagcatggaagaggaaatgggcgatgtgctgttcgttctgatctgcctcgccaactcccttgatatttcattggaggaagctcataaccgcgtcatgcataaatttaatacacgtgataaagaccgctggactagaaaagaagaaggaaagtaggagaaaccatgtcaaatgaaaccattaaagtcgtcattgccggaccgagaggcagaatgggccaggaggccgtaaaacttgccgtccgcacgcctcattttgagcttgtcggcgccattgaccatacatacgatcagcaaacattacgggaagtgatgtcagctgattcagacgctcttatttatacggatatccgcgcatgtttccaagaaacaaaaccggatgtgctgatcgatttgacaacgcctgaaatcggcaaaaaacatacgaaagccgctcttgaacacggcgtccgccccgttgtgggaacgaccggattttctgaagcggatttagaggagcttcaagccttgactgaagaaaaaggaatcggcgccatcatcgctccgaattttgcattgggcgcggtgctgatgatgaagttctcacaaatggccgccaactattttgaagatgtagaaatcattgagcttcatcatgatcaaaagctggatgccccgagcggaacggcgctgaaaacagcggaaatgatttcaagcgtccgtacagaaaagcagcagggccatcctgatgaaaaagaaattctgccgggcgcccgcggtgctgaattaaacggcatccgccttcacagcgtgcgtctgccgggccttatcgcccaccaggaagtcatgttcggcatggacggccagacgctgaaactgcgccatgattcctataaccgggcttcctttatgtcaggagtgaagctgtcagtggagcaagtgatgaaaatcgaccagcttgtatacggactcgaaaatattatcgactgaatcggcaagggggagaacatcaaatgaaaattgctttgattgctcacgataaaaaaaagcaggatatggtccagtttacgaccgcatataaagatatattgagccatcatgagttatacgcgacgggtacgacaggcttaaaaatccaggaagcgaccggattgtccgttgaatgttttcaatccggcccgctcggcggagatcagcaaatcggcgcattgattgcggcaaacgccctggatctcgtcatttttctgcgcgatccgttaactgcgcagcctcacgaaccggatgtctccgcgctgatccggctgtgtgacgtatacgcgatcccgctcgccacaaatatgggaacagcggaaatccttgtccggacgctggacggcggggcatttgatttccgcaatcttgtgcgcggaggagagccgaatgtctgaacacgttgatattctggcgttcggcgcccatagtgatgatgtcgagatcggtatgggcggcacgatcgcaaaatttacggctcaaggaaaaaccgcggtgatatgcgatttgaccgaggccgaactatcatctaacggaacggtagggataagaaaagaagaagcggcagaggcggcacgaattctcggcgtaaaagagagaatccagcttacgcttcccgaccgcgggcttttgaaaagtgaggacggcatccgccggattgtcagtgtcatcagagcctgccggccgaaaaccgttttcatgccttatccgaaagaccgccatcctgaccacggcaatgcggcggctttggtcgaagaagcggtgttctcggcgggaattcataaatacagagatcatcaggaactgccggctcataaggctcagcgcgtatactattatatgatcaacgggtttcaccgtccggactttgtaatcgacataacggaaaccatcgatctgaaaaaagaaagcctgcacgcttatcaaagccagtttattcctacggcgcagtcagtgaacacaccgctgaccaacggttatatcgaaatggtggaagcgcgggaaagactgtatggcaaagaagccgggacggggtatgctgaaggcttcttttcaaaacagcttcccgttttgaatgatgatgtttttgggggcggacaatgagaccattaaaaatagggattacatgctacccgagtgtcggaggctcgggtattattgcgacggaactcggcaagctgcttgcggaaaaagggcaccaggttcatttcatcacatcaagcatcccgttcagattaaatacatatcatccgaatattcattttcatgaggtggaagtcaatcaatacgcggtatttaaacatccgccttatgaccttacactggcgagcaaaatcgccgaggtggccgcgagggaaaatcttgatatcattcacgcgcattatgcgctgccgcatgcggtatgcgcttatctagccaaacagatgctcaagcgtgacatcgggatcgtgacgacgcttcacggtacagacatcaccgttttaggatatgatccgtcattaaaagatttaatccgttttgccatcgaagcgtccgacagagtgacggcggtatcaaccgcgcttgccggagaaacatatgacttaatcaagccggataaaaaaattgagaccatctacaactttattgatgaacgtgtttatcttaagaaaaatacagagagtataaaagagaaacatggtattttgccggatgaaaaggtcgtcatccatgtttcgaacttcagaaaagtaaaacgtgttaaagatgtcatccgcgttttccgtaatatcgcagccaacacaaaggcgaagctcctgcttgtcggtgacgggccggaaaagtgcgtcgcttggcagcttgtcgaaaaatacggactgcaggatcaagtgctgctcctcggaaatcaggacagggtggaagagctgtattccatcagcgatcttaagcttcttctgtctgaaaaagaaagtttcggactcgtcctccttgaggcgatggcctgcggcgtgccgtgcatcggaacaaatatcggcggcatcccggaagtgattaaagatcaagtaagcggttttctggtggaagtcggcgatattcaggcggcatctgaaaaagcgcttgccgttttagaagataaacagctcagcaaacgattgactgatcatgcgctgaaaatggtggagacctccttttcttcgcaaagaatcgtcagtcagtatgaacggatttatgacgaattggcaggaccggagtgatcttatggaacaggaatttgtcaaagccctccccatccttcatcatctgatgaaggcgggccatcaggcgtactttgtcgggggagccgtcagagacagctatatgaaacgaaaaataggtgatgtggacatcgcaaccagcgcttcgccgaatgaggtggagcgcctctttaagcggactgtcgatgtaggaaaagagcacggcaccgtcatcgtcctgtgggaagatgaaacctatgaagtcaccacttttcgtgccgaatcagaatataaggactatcggcgcccggaagctgtgcggttcattacttctttatcagaagacttaaagcggagagacttaacgattaatgcgatggcgatgtctgccgaaggagagctgcttgattatttcggaggcgcacatgatatcggacaaaagctgatccgtacggtgggtaaccctgaagaccgttttcgggaagacgctctgcggatgatgagagccgtccgctttatgagtcagctcggctttctgttagaaaaagaaacaagagaggccgtcataaaagacagggagcttttggcacatgtatcagtagaacgaaagaccgtcgagtttgaaaagctgatgcagggcgctttctcacaagaagcgattcaaacgatggtgcagacaggtctgatacaagagctgcccggcctttccggttatgagcagcaaatgcttgaagcaagcggctttccgttttcttctttagatgcacgcgaagaacgctgggcagcgctgttattgtttctcggtctttgtccgaaaagtgccgaggcgtttttaaaacaatggaaactgccgggaaaggtcataaaaaaagcggtgcagatcataagcgtttatccggcgcagctggaagcagaagcgatgtaccgagcgggagaggcgctgttttcagccgttaaaatcgggatgctgaaacagcataagacgattgatgaacaaaagctgaaagaggttcagagcctgtatgagcagctgccgatcaaaagccttcgagacctcgacatttcaggcgctgatctgatggagctcagaaaccgccgcgcgggtaaatgggtggccgaagaacttcgccggattgaagaagcggtattggcagggaagcttcctaaccgaaaacatgacataaaggagtggctcgcatcatgggatcaacattaagaacccgattaattgatttattttctgaggcgggtgacggctttatctccgggcagaaaataagtgacgcgctcggctgctcgagaaccgccgtttggaaacatatagaggagctccgcaaagagggctatgaggttgaggcggtcagacgaaaagggtacaggctcattaaaaaaccggggaaactcagtgaatccgaaatccgtttcgggctgaaaacagaggttttgggcaaacagcttcattaccgggacgtcctgccgtccacccaaaaaaccgctcatgaacttgccaatgacggcgcgccggaagggaccctcgtagtcgccgataaacaaacggcaggcagaggaagaatggccagagtatggcattcacaggagggaaacgggatttggatgagcctcattctgagacccgacgttcctttgcaaaaaacgccgcagctcaccctgttatccgccgttgcggtcgtacaggccatcgaggcttttacaggcgtacaggccgccattaaatggccgaatgatttaatgattcacggcaaaaaagccgtcgggattttaactgagctgcaggcggaagaggaccgtgtccgttcggttattctcgggatcggcatcaacgtgaaccagcaggaaaccgattttcccggcgagcttcaggacattgcgacgagcctgagcatggaagccggtgaaaaaattgacagagcgggtctgatacaagagattctgctgacttttgaaaaacgctatcaggattacttgaaccacggctttacaccgatcaagctgctatgggaaagctatgcggtcggactggggaacgagctcagagcgagaacgctgcaaggaacgttttacgggaaatcgctcggcattgatgatgagggagttcttcttttggaaacgagagacggtataaagaagatctattctgccgatattgagctcaattaatcttagttggtacaagcctcgtgaatttggtatacttcctatgggcagtatcataatgaactgcacctgatcagcagaacagagattacgaaaagtctgccttgatccaaaaaaggactgggacagagggatgacattcgccgaacgttaaacaagtgggaatccttcttattttacagaaggcttttttgcttgcgaagaattggcggctcatctcctcaccgtttagaggaggagaaacagaatgaaaacaaaactggatttcatgaaaatgaaggaaaacggagagccgatcgtgatgctgaccgcttacgattatccgcaggcaaagcttgcggaacaggcgggagtcgacatgattttagtcggggattcgctcggaatggtcgtgctcggactcgattcaaccgtcggcgtaacggtcagggacatgattcaccatacaaaagcggtaaaacgcggtgcgaaaaatacgtttatcgtaactgacatgccgtttatgtcttaccacctttcaaaagaggatacattgaaaaacgccgcggccattattcaggaaagcggcgcggacgcgttaaagctggaaggcggagacggcgttttcgaatccatccgcgcgctgactctcggcggaattcccgtcgtcagccatttaggcctcacaccgcagtctgtcggcgtattaggcggatataaagtgcagggaaaagatgagcaaagcgcgaaaaagctcattgaagacagtatcaaatgcgagcaggcgggagcgatgatgctcgtgcttgaatgtgtgcctgctgaactgactgctaaaataatagaagaagtatccattcccgtcatcggaatcggagccggttcaaaagcggacggccaagtccttgtctatcatgacgtcgtcggccacggcgtggacagaacaccgaagttcgtgaagcaatacgccaaaatcgacggcacgattgagtcggccctcagcgattatgtccgtgatgtgaaagaacgggttttcccggaagaaaagcattcctttcagataaaccaaactgtgctgcaaggcttatacggaggaaagtaagcgatgaaacaactgacagaaactcaacagctgaaagaattaattgcacaataccgctcagaaggccggacgatcggattcgtcccgacaatgggttttcttcatgaaggacacctgaccctggttgaaaaagcaaacaaagaaaacgatattgtcgtgatgagcatctttgtcaatccgactcaattcggaccgggcgaggattacgaagcatatccgcgagatttaaagcgcgatgcccggcttgcagaacaggcgggagcagatgttttgtttacgccgtctccgagtgacatgtataagggcgagcaaaatgttgccgtgcaagtgaaaaggagaactgacgtgttgtgcggcgtctcccgcgtcggccattttgacggagtggccactgtgctgacgaagtttttcaatctcgttaaaccgacccgcgcctacttcggcctgaaagatgcccagcaggcagcggttgtggacggattgattgaggatttctttatggatatcgaattggttgcagtggacacggtcagagaagaagacggacttgccaaaagctctcgcaacgtctatctgactgagcaggaacgcaaagaagcgccgatgatctataaagcattgcagcaaggtgccgaactggtcagagacggtgaaagaaatccggaaaccgttataaaaaccgtcaccggtatcatcgaaaacacaagcggcgtcattgattatgccgaactgtacgcttatccggagctgactccgcttaaaacattaaacggcaaggtcattctggcctgcgccgtccaattttctaaagccagactgattgataatatcattattgatattgatgaatgggagagatcataatatgtaccgcactatgatggccggaaaactgcaccgcgctaccgtgacggaagccaatttaaactatgtcggcagcatcacgattgatgaagatcttttagatgccgtcggaatgctcgctaatgaaaaagttcagattgtgaataataacaacggagcgagacttgaaacgtatattattcccggtaagcgggggagcggcgtcatctgtttaaacggagctgccgcccgtctcgtccaagaaggagataaagtcattattatttcttatcaaatgatgtctgatcaggaagcaaaaagccatcagccgaaggtggccgttctggatgatcagaataaaatcgagcagatgctgggccaggagccggcacacacgattttgtaaaagagcccccttcatgggggttttcttttaagatttaggggcaaaagctgtttttccgctccatttctcaacaaaacgtgttacacttttctcgtatgcaagaattgaggtgtccattttaatgaacaaacaacggttcgttgtcatagatgtcgaaacaacaggaaattcgccgaaaaagggcgataaaatcattcaaatcgcagcggttgtcattgaaaatggacaaataactgagcggttttcaaaatatatcaatccgaatcaggccatcccgccgtttattgaacagctgaccggaatttcgtccggaatggttgaaaatgaactgccgtttgaagcggtcgcagaggagatttttcatctgcttgacggcgcgtattttgttgcccacaatattcatttcgacctcggatttgtccggcatgaactgagcgaagcgggctatgagctgccggattgtgaagtgcttgatacggttgagctttcgcgtattgttttcccggggtttgaaggatataagctcggtgagttgtgcgcagagctgaatattgttcatgaccgccctcaccgcgcagacagcgatgcggaggttacgggcctggtctttttagacattttacataaactgaaacatctgcctttaccgacgttaaagcagcttagaaggctttcacagcattttatcagcgatttgacgctgcttttggattcttttattcatgaaagcaggccggcggaagaaaagagctgcattccatacgcctctttttcaattaaagagcccgatcacattccggtttcccgtccggtgaatgcggccattgaccttgaaaagtggaacgaagaaaaagaacagatcttgtccggcatcatcccccgctatgaaaagcggaaaggacagcttacgatgatggatgaagtgcttggcgccttccgcaatcgggagcatgcgctgattgaagcggcgcccggcatcggaaaaacgatcggttatctcgttccggctgttttatttgccaaagcggaacaaactcccgtcattatcagcacgtactctactcttttgcagcagcagatcatgtctaaagatcttccgcttttggagcgtatgtttccttggccggtcaaagctgctattttaaaagggaaatcacattatctgtgcctgccgaagtttgaacatattctgcatgaggaagatgacaactatgatgcggttttgacgaaagcgcagcttctcgtctggctgacggagactgaaacgggcgacgccgctgagctgaatcttccatcaggcggcagattgctgtgggagcgcatggcttacgatgagaattcttttatgaaaaaagggaaggactcggctgccgggttttatgaacgggctaaagaaaaagcgcaggccgcagatctgattatcacaaaccatgctttgctgttttcagatcaaagcagtgaaacgaaaaaactgcctgcaagcggaacggtcatcattgatgaagcgcatcatttcgaacgcgccgccagcgagcacctggggaagagagcttcatacatcggactgcacacaaagctcagccgaatcgggaccttaaaggaacacggactgttaaagcggatgagaaaactgttttatacgtatgaactgccggcggaaagtttttttgacgccgatgagtggatgaagcatattcaatcggaaagcgacgcatttttcagttcagtgcattcttttgtcaaacgaagaaaacctaaagacgatctgaaccgtctcgtctatagtctcaatcataaaagccaggataaagggtttcacatgataacggacggagcggagcggctttgtgcgatgcttgatcagctgcttgacatgttttccgtacaggagaaactgttacatcaaaagcttgatcagatgaaaagcggagcggcttttttagcgggcgaatatgtaaagtgtatcagggggctgaaagaatatcgcgatacgttcagcaggctgctgtttgaaaatgatgagaaagaagccgtttgggttgaaattgatgcgaagggcgcaaaaaatgccgtcagcatctatgcgcagcctttggagcccggtgaaatgctggcagaccagtttttcgcccgcaaaaaaagcgttgtgctcacatcagcgaccttaatggtggagcagtcttttcaatttatgattgaaaggctcggacttgcggatttttatccgcgcaccaaaagcatcccgtctcctttttcttacgatgatcagatgaacgtcatcattccgaaagagatgaaatccgttaaatatgacggggagcgggaagtcattgagcatattgccaagtatgcagaaatcatgtcaaagggaaaacagccgaagatccttgtcctgtttacgtctcatgatatgctgaaaaaagtgtatcaggaactgaaactcagtatggagatctcaggcattcagcttctcgcccaaggtatttcaggcgggagtcccggtaaattaatgaaaacctttaaaacggcaagccggtcgattttgctcggaacgaatcatttctgggaaggcgttgattttccgggggatgaattgtcaaccgtcatgatcgcaagacttcctttcagggcgcctgataatccgcttcacgccgcaaaatgcgaatttgccaagaagcaggggaaaaatccgtttcagacgatttccctgcctgaggccgtgttaacgttcagacaggggatcgggcgcctgctccgtacggcgggagacaagggaacgatcgttcttttagatcagcgtgtaaagacggcgggatacggacggctgtttcttgaagcgctcccgacttcatcccttttggagctgacggatgccgaactcggggcttatgtcagccaaacggaataaaagccgcataaacgcggctttcgtggtgtgggatgaggaattgtttttatagtaaaagcgggttcatgccgccttgtgattttattatgccgcgggcgcatcccgttatgactaacaaaatttgttcgaccgatggagggtataaaaatggaaagcaaaattgaaattctgtcaacgattaatgtggagcattcagatgatttatataaaatcgtcgatacattaaaccggactttgaaacgggacaacctgatgttcggccttgcgctcgacgaagaaaatcaaaatgaagcggtcttcaccatttatcgcacataggtgaaaaagatgagaaaaaaagcattaatatttacagccgtatttggtattatttttttagcagttcttttattttcggccagcatttttaaatctgcaatggctcaaaaagaagaaggccacgaaacagctgccgcagccgctaaagaaaaaacgaatctgacagacgctgagaaagtggagacctttgtcggcaaacagaaatattatgttgttaccggaacggataaacatggaaaagatatgtatgtatgggttccggccgacaaaaaagcaaaaattctctcaaaaaaagccagtgacggcatttcaagcggcaaggctgccaagatcgttcgggacgaagggcttgtttccaagctgaatggcgttcacccggcgagagaaaacaatgttccgttatgggaagtgacctatatcaacaaaagcgggcagtatagctttagctatgtggactttacaagcggcaagattctcaaaaacatcacaccgtgagacgtattagggggagttcaagttgaaattggcaaaaagagtatccgcattaacaccgtctgcaacacttgcaattaccgcaaaagcgaaagagctgaaagcggaaggccatgatgtcatcggcctcggagcaggagaaccggattttaatacgcctcagcacattatagatgccgcggtgcgttccatgaatgaaggctatacgaaatatacgccttcaggcggtctgccggccttgaaagacagtatcgcaaaaaaattcaaaaacgatcaggggattgaatataagccgtcagaaatcattgtctgcactggagcgaaacacgctctgtatacattatttcaggtcattctcgatgaaggggacgaagtgattataccgactccttactgggtcagctatcctgagcaggtgaaactggcaggggggcgtcccgtctatgcagaagggctggaatccaatcagtttaaaatttcaccggagcagctgaagcaggctatcaccgagaaaacaaaagccctcattatcaattcaccgagcaacccgacaggtgttatgtatacgaaggaagagcttgcggaactcggaaaagtgtgtctggagcatggcattctgatcgtttctgacgagatttatgagaagcttacatacggaggaaaaaaacacgtctcaatcgcacagctttcagatgaattgaaagagcagacgattatcattaacggcgtttcgaaatctcacagcatgacgggctggaggatcggctatgcggcgggttcggagacgattattaaagcgatgacgagccttgcgagccacagcacatccaatccgacgtccatcgctcaatacggcgccattgcggcctataacgggccggctgagccgcttgaagagatgagacaggcatttgaggacagactgaataccatttacgctcagctcagtgagattcccggattcacctgtgtcaaacctgaaggggcgttttacttgttccctaacgccaaagcggccgcagaaaactgcggattcaaagatgtcgatgaatacgtcaaggcgcttctggaagaagaaaaagtcgccatcgtgccgggctcgggtttcggttcaccggacaacgtccgcttatcttacgcaacgtcactcgatcttttagaagaagcggtcaagagaatccgccgctttacggaaaaacacagctgattctgaaaaagcggcttttaaagccgcttttcacttgcattgaccccgttagagtagaacgggtataataaagtgatgaaaaaagagattcaggcagattcctgaatgtctttcttgttctggagggaaagagtttgaaaacaacaatcaaccaagtgtataaacacacaggcgaggaagtaacgattggagcttgggtcgctaataaacgctcaagcggtaaaatcgcatttttacagctgagagacggtaccggcttcattcagggagttgtcgtcaaagctgaagtagaagaagacatcttccaaattgcgaaatcagtgacgcaggaaacgtcactttatgtaaaaggaattgtgaaagaggacgagcgttcaccgcttggctatgagcttgctgttacatccattgaagtcattcacgaagcgactgattatccgattacgcctaaagagcacggtacggaattcttaatggatcacagacatttatggctccgttcgaaacgccagcacgcgattatgaaaatccgtaacgaaatcatccgtgcgacttatgaatttttcaacaaagaaggcttcgtgaaagttgatccgccgattttgacgggaagcgctcccgaaggcacgactgagctgttcgcgacgaaatattttgatgaagacgccttcttgtctcaaagcggccagctgtatatggaagcagctgcaatggcgctcggaaaagtattctctttcggaccgacgttcagagcggaaaaatcgaaaacgaaacgccatctcatcgaattctggatgattgagcctgaaatggcatttgttgaatttgaagaaaaccttgaagttcaggagaattatgttgcatacatcgtacaaagtgtgctggaacattgtaagatcgagctgaacacattaggaagagacacatcgaagcttgaacaaatcaaagcgccattcccgcgcattacgtacgataaagcgattgaattcctgaaagaaaaaggctttgacgatattgagtggggagatgacttcggtgcgccgcatgaaacagcgatcgcagaaagctatgacaaaccggtgtttatcactcattacccgacgtcattaaaaccgttctatatgcagcctgccaaagatcgtgacgatgtcgtgttatgtgccgacttaatcgctccggaaggctacggggaaatcatcggcggttcagaacgcgttcatgatatggatttattggaagaaagattaaaagaacacggtctggattcagatgcttacaaatggtatgctgaactcagacaatacggttctgttccgcactccggcttcggtctcggacttgagcggacagtggcttggatcagcggagcgcctcacgtgcgtgaaacgattccgttcccgagacttctgaaccgtctgtatccgtaatagttatgaaaaacgaagtctcctgcaagggagactttttctaagtaaaggggaaagctcccggagataaccttttacagtaagaggtgtaaggatgaaaaaacagcaatttatagatatgcaggaactcggcatttcaagcattcccaacctgctgctgacacattaccggcagctcgggctgaatgaaaccgaattgatcctgcttttgaagattaaaatgcatttggaaaagggctcttattttccgacgccgtttgaacttcaatcaggcatgtccatctctgctgaagagtgtacaagctgcctgagaatgtttattcaaaaaggttttctgtttattgaagaatgtgaagaccataacggcataaagtttgaaaaatattctctgcagccgttatgggcgaagctgtatgattacatgcagcattctcaaaatgaaacgcaggaaagaacgtcagaaagagaacaaaaaagcctgtataccatctttgaagaagagttcggaagaccgctgtcgccgcttgaatgcgagacgctggccatatggcaggatcaggatcagcatgatgcgattctgattaaacacgccttaaaagaagccgttttatcggggaaactcagttttcgctatattgaccggattttatttgaatggaaaaagaatggcttcaaaacggttgagcaggcgaaggcgcacagccaaaaattccggcgtgttcaaacgaaacagaatgatccgcaaaaagagtatacgaggcaggtacctttttacaattggctggaacaataacatgagaaggggagaaacgtgttaaatttaaagcagattgaatattgtcttgaaaaaatcggcgatatgtttccgcacgcagaatgtgaacttgtccattcaaatcctttcgaattggttgtggcagtcgcattatccgcgcaatgtacggacgctctcgtcaacagagtgacaaaaacgctatttcaaaaatataaacggcctgaagattatcttgccgtatcgctggaagaactccagcaggatattaaatcaatcggtctgtaccgtaataaagccaaaaatattcaaaagctgagcaaaatgatcattgaagagtacggcggagaagtgccgaaagaccgggatgagcttgtgaagctgccgggtgtcggacggaaaacggcaaatgtggtcgtgtctgttgctttcggcgtacctgcgatcgcagtagacactcatgtggagcgggtctctaaacggctcggcatctgccgctggaaggactctgttttggaagtagagaaaacattaatgaaaaaagtgccgaaagaggattggtctgttacgcatcacagattaatatttttcggccggtatcactgtaaagcgcaatctccccgctgtgcggaatgtcctttgcttccgctatgcagagaagggcagaagcgtgacaaaaaagggctggtgaaacggtgacggcgattgacattctggcaggctatgaaacatacctgcgcagccttacggacttggaaagcctcgagatcaaagcggcgctgcgccgccatccgctgtatatggatttcagcggccagccaacagtgcagccatggagggaaaggggcgaatatgtcccgtttctttttcagatttggaatgaaacgaaagaaacgctgcttcccgtttttcaaacaagaaaatcgaggtgtgatcaaaatgacatgctgaagggaatagcctgtctgattgccgcttttcattggacggcaggggagcgggtcacatcactcgactggactgtgcttgaaacaaagcattttcccgcggaaccgatcaattgggcggagcgaatggcgtttattttaacaaaaccgactcaatatcactcgtttattcagctggatgaattgatgacggagatgaagaaacaatatcataaatatgaagccatgaacaaatgttaaaaacctccttttcccataaggaggttttttgtacgaaaaaaatccttcacctgtttggggtgaaggatttcgtccgctaatgagcgggatttgactggatggttgacgaattggactgcccgttgatagttgaagatgagtcttggtttttatccgtttgaccgctgtcaggtttatttgagccgtctgaaccggaatcggaatcattatcagagccgttatcttgctgtccgttgttatcggtcccgttgccgggctgattctgattgttgttatctgtttgatccttatcggattgatcctgatttttatccgggtcatcagttggtgtttgatccgatccgtcagacgtatctgtctgatcgtcatctttgtttgaatcatcggtttgcgtcttgtccttatctttatcttcatcagtcttctgttcatcgtcagtcgctttatctttatccgcatcgtcttcttcatctttcgggactttgaaagatgctgatgccgtatcgctttttccgtcatcgttttccgctgtcacctggaagctgtatgtggagcctggcgtgacatttgagacgacggcttcttttgccgaactgttttgaatgtcactgtagcttccgccgtcaacggattgtttgacattgaatgttgcatcaccgtcataatcccagcttaaggttaatgattttttatctttgtcgtatttcacttgcaatcctgtcggtttatcggctttttctttcgtgtacgttttagaaacggcagttggctgcgttcctttcacgaagtactccgtcacttttttatcatccggcgtattcggtccggctaaagcggcaggattcgagcctttctcaactgtttcttttacaacgctgtcaggctgcttgaagcttcctttaccgtcatcaacgtatgagatcagcttttggaaaatccgttttgcgacttgctggtctgcagaagacagtgatttcttgcctgctttgttgccagactcaactccggtccaaaccgccgctgtatattgaggggtgtatccgacaaaccatgagtctgggactccgcctggagcaatgttatatttttgaatgtcctctttagtaaagttggtcgtacccgttttaccggcgacttccacgttcgccacctgagccagtttacctgttcctgattcgacagctgatttgagcatatctgtaatcataaacgctgtgtagtcgctcatagcacttttcggtttcggtgttaaatcaagcttagtgccgtcattaaattcaatcgatgtgaccgcgtgcggttcgttgtacgttccgttatttccgaacgcactgtaggcgcctgccatggtcatagtagatacaccgcggttaccctcaccaaatcccccgatagagtagggttcatatacttgatctttgtttaatcccaatcctaagtcgtttgcgaagtcgacggcatgatcttttcctgctgcttggtatgcttttaaagcaggaatattacgtgagtctgcgagggcctctcgcattgatatctggcctctgtatttattgtcccaatcatgaatcggtgtgccgtcagagtacgtataagctgagtcgtcaatctgttcatacgtcgaccattttttattttcaatgaccggtccgtaatcaagaatcggttttatcgtcgaaccgggctgggttttaccttgtgttgcataattgaatcccccggtagttctgttccgtcctgccccgatggcgcggatttctccgtttgtcgtatcaaggagcgtgacgccgccctgcatgccttcggtaaatccggctgtatcgccgttcatcaattgatcaagataatcttgtgctttcgtatcaagagtcgtgtaaattttcagtccgtcagttgaaatatcgacgtctttcttttcttttgtctcaatttctttcataacttcttcgacaaaagcgctgtatttatttgtgtcctttttatcgtattccttttggctgacgacgccttcatctttcatggacactttcttcgctttttggtattcagagtttgaaatgaatccttgtttttccattaagctgagaacgatgtttcgtcgtttttcggaagccttcgggtttttaaccgggttatatccggtcgggctttgcggcattccggcaagcgttgccgcctgttcaaccgtaagcttgctcaagtcttttacgccgaagaattcttcagccgcttttccgacgccgtaggcgcgcggtgagaaataaattctgtttaaatacatttctaagatttcatctttagaataatggcgctccagctgcagggaaagccacacttcctgtgctttccgtttaatcgttttctgatgggtcaaaagcgagtttttcacaacctgctgggtgattgtgcttcctccctctgaaccgaacccatccgtaaagttggcgaccaaagcgcctccgatacgaatcgggtctataccgtggtgcttataaaaacgggcgtcttcagttgcgataaatgcttctttcacaacatcgggtatatccttaatcgggacgtaggttcgtttttcaccgcccacttccgcgatttcttttccgtttttatcgtaaatcgttgaagagtaaggcgttttcagcttggcttcgtccaaagacggcgcgccggaaaccaaaacggcaaatgccgccgctccgccgactatgccaaggacaaacagaataaccaaggacagcacaatctttttgaataaaccgcctttacgctgtttcttgccttttttcggtgaagagggcttagtgcttttcgtctgccttgccttacggcgttcttcacggctcgtaaattgatctgacataacatctcaacctttcgtttatcaacctttcgctcagtctactgttcctgcgaaaaataaagctgttcaataatactaatataatcaattctcggtgagtatccaagggaaatcggaaaggaagcatcttctaattcgtctttgcgaattgattttctgccgttcttctcctttctctcccaaaagacaaacagcttgtcggcttcgaggaaataaacctttccgaaagcggatataataacaaaacaaatgccgtcttgcctgaccacctgcttcatatgctcaatctgatgatcatgaaaattctgcaggggaaatgccgttttgttttttgtttcttttgcctcgaaatcgatgtagcgtcctttataaatgccgttgtagtcagttgttgaagactgtttaaaataagcttccttaatgactgcggcgcttcttttcggatagtggacgtttacaatctggacgggtgtcggctttttgtgaatgacagcaatttggttagccagataatacttattcgtttcattcaggtcgtcttcgagggtcatgccgcgattactgtatgaatgagaccgtttctggctgttttgggatgaaaccgttttgttcggctgaaaagtttttccattcgggtaccgaatcactttttccatcctccttatcaaactaatagtgacggaagtgaatgaacgtgcataaacgacagaccgtaaccgccattcttcgcctgatcgaaaaagagacgaaaataaaaaatgccgataatatttcccggacgaatgcctataaagcatattatgaccgccatcctgagatcaagtggccgcttttggcatcctttgtgtcccgcaatgcgggctggtcgatgactgatttaagaggcgtcctttatcaggagggccttgacagcagtcagaaaaactggtttttcctttcgtatgaaagggcgaattggctgattttttctgatgcctatcctcagcttctggtctaccagtggtcaaaacaaatcggcgaacctcttttccgtcatcttccttatttccgcgtctcggcttttatgcaggaagaatggttccgcttttggcgtgacggagatacggaacggctcatgtatgctcttattataaatgaacaaaacactatccaagcacctattatacaaaatccttcgtttaaaaagaatgtttttggcacgattcctttttatttaagtgattggtttcactttaatacggtgatattcccttcatttgacggacatttatacggaatttccgtcaaacggttttcaaaaaccgaagagagaattacgctcggaaaacagctggcccgccttctgttcagccctgatcttcacgcttctttttaccgttttcttgataccgttcctcataccggttcacgctttgatatggagaaaatgatcggcatcaaaaaaagaacatcaccgatgcttaggacaacctatcccattgttgcccacccattagacggcgaaagggcggattggtttcaaaaaaggttaagaaaaggggctttcttacaggagaaaatgccgaaacagcttgaactgacggactggtacttccagaaaagacgggagctccatgcgctcttcgcggttaaagagtggctgaagaaatgaaaaagcccgaaaccgttcgctggggtttcgggctgctgatgtgttacgtggaagggcggtttgggccgcctaattttttatcaagcgtatcagtcgtttttgcttcggttttttgctgtttacctgcatttttcggtctcgttttcatacggcacctcctcaactgtatcgtttgcattaacgtgccggttcatacaaagtttgcggcacttttttgtcgaaaggcacgccttttaggataatctctgtttgtttgccgaactgcttctagttttgtcatgtgcagaggagagcggtatgaaaacgagaattatatttgaaagagatgcaagtgataaaagggaggaacatgaatgtctgtttacacgagcaaggctgatattctccgtctgctttctgatatcgaaatccggatttctgctgctgaaaaaacgcttacccaagcagtcagatgctgtcaggcggaagctgaagaaatcagacaggagaaactttcccgtcttgaggaagaggcgcgggagcttcatgtttgtattgatgacctgtttttgactgaccggcgtaaaaaggatttgccgcgagtctgccggataagctgattttgtgcaaaaactttggtaccatatgtactgaggtgagtccgtttgcagacacagtcgttattggagctgacagaacaaatgatagaggcggttctggaagccgaaaaaaggtatcaggatggaaaagagtcaggccgttcatatgatttttttgagacgattaaacccgatgttgaaaaaagagaccggctttgcgcgctttggacagaagcagcgcttgcgtttattcaggaaaaccgtccgaaatacgttcatcatgcacaaattcaggccgttacagaaaatttcggggagctgatgctccaatcatatgttcatcatattcataaaaaaagatacagggatttaactgaatctgttttatatacgcttcgtatattaagggatgaaattgaaaaagaaggcagctgaaaacggctgccttcttttatataaaggggtcgggtatgttattcatacgccgggttttctgctccacttgcttcgagaaccttcatactgtttcgaaattcggttgcggtgagatggccttgaatatagaggaattttgcaaagtccatcagtttatctgcacaatctgtttcatattttttcacttcagcaaaacgctttcttaagtatgatacgttcataatggtgcatcccctctcatgtatgttgagattatgttaacataacgattcgacttttttctgtttttaaaaaattaagactttcgacagcatttgacaaagagcagaatcaccgaaagcacataaccaaggcggaattcatacatatatagcagaaacttagtgagagacaaggggggaatgtcatatgcaatggagagcgcagccatatcaaaatatgtaccagcagccggcgggatatttctacccgcagcagatacagccattacagccgccgtatccgcagcagatacagccattgcaacagccgccatatcatcagcaagggcagtacccgcagcaattttatccgaatcaggaatacggtcatatacagcagccgtttgctcctgctcctcctcaggcaggcatgcccgggggccagccggggtttgtgaatccttaccccgttcccagaccgaatcagcagcagtcttcccaattctcaggcatactctcccagtttaaaaaaacgaacggacagtttgactttaataaaatgatggatacaacggggcagatggtaagcgccgtaaatcaggtcggatcgctggtgaaaggcttcaccagtatcttcaaataaaaagcatgaatgatatccatcattcatgcttattttttagggaaaaagaaggtaagcgtctgttcattccaggatgtttccatatcttcttcacttaccttatacgggaggacaacggttcttgtcatgcttgaagacacatgggatgattgagcctgtttatgatcgtagcggattgtaacgtgaaggtagcaccctttcgtttccaccagcatatccccgtcacggaacgtctcgggaacgccgatatcaaccgcgagccccgtcggctcttctctgacgtcaatcgtcacttgcgcttcagtaaaagccgaattgacaaggtgctgaaaaccctgcatcaattctgcgaagggacctgagtgaaaaaattggtccatcgcatggctgatgatgtcctcattactttgcggatcaagtttatcgttttgggattgatccatatgaccaccgcctttttacaaacagactatgcgatgctatgccgtatggttaagaattgaaggaaaaaagaaagtatggttaaatagtggagaataaactggtaacggattcacatttaggaaggggagcacaacacattgctgaaaaaattattcggattgggagacagccggaaaaagccggccgaggaagtgattttttctccggctgacggagcggtgatggatttggcttcagtgccggatcctgtattttcacaaaaaatgatgggggacgggatcgccgtcgagcctgcaaacggagaaattgtttcaccggttgagggagaagtgattcagctgttccatacaaaacacgctgtcggcatccgcaccctttccggagcggaacttttgatacatgtcggtttggataccgtcaatatgaacggcgaaggctttgaagcgcatgtaaaagaaggagacaaagtgaaaacaggcgatctgcttttaacgtgccggctggatttaataaaagaaaaagcaagcagcaccgtcatccctatggtgattatgaatggcgatgccgcagaacctttgcaatttgcaggcgcaaatgaagcgaaaaaaggacaaacagagctttttacgataaaaatgaagtaggcaggggctgattccctgctttttttcttgtgcaggattttcatctagccaggcaaacaaatattcggtaaactgtacctcataaagaggtgtgaacgatgaagaaaaaatcactgagcgaactgattcaggaattaaaaaatcatgaaaatattgtgcattggcatgaagaggaaccgcgggaggcgaaaacgatgccgatgccggagcaagtagatccgaacattcgggcggctctcgaaaagagggggatcgagcggctttttacacatcaatactccgcttttcagacggttcaaaacggagaaagcattgtggccgtcacaccgacggcctccggaaaaacactgtgctataatcttccggttcttcagtctatcgcggaagatgccacaagccgcgcactttatttatttccgacaaaggcgctcgcgcaggatcaaaaaagcgagctgaatgaaatcatagacgagacgggcatggatattaaaagcttcacctatgacggagatacgtctccggctatcaggcagaaagtcagaaaggccgggcatattgtgatcacaaatcccgatatgcttcattcagccattcttccccatcatacaaaatgggtgagtctgtttgaaaacctgaaatatatcgtcattgatgaattacatacgtaccgcggtgtattcggcagccatgtggcgaacgtcatccgccgtttaatgagaatctgcgctttttacggaagcaagccgtcatttatctgtacatccgccacaatcgccaatccgagggagttggcggagcagctgacgggaaaatctgtgcgcctgattgacgacaacggtgccccggcaggaagaaagcactttgctttttacaatcctccgattgtaaataaaccgctgcatattcgaaaaagcgccaccgtggaagtgaacgaacttgccaaaacttttttaaaaaataagatccagacgattgtttttgccagaagccgtgtccgggtcgaaattattttaagccacattcaggagatcgtaaaaaaagaaatcggcgcgaagtctgtcagaggctatcgcggcggatatctaccgaaagaaagaagagaaatagagcgggggttaagagacggcagcattctcggcgttgtcagcacaaacgcactggagctcggcgttgatatcggccagcttcaggtctgcgtgatgacggggtacccgggcagtgtcgcgagcgcatggcagcaggcgggccgggccggacggcggcagggagaggcgcttatcgtgatggtggcgaactctgatccgattgaccaatatattgtgcgccatcctgattatttctttaaacgctcgcctgaatctgcaaggattaatcccgataatctcattatattggtcgaccacctgaaatgcgccgcatatgagctgcctttcagagccgatgaaacattcggagaaaatgatgcgagggacattctcgagtatttagaggaagaaggggtgcttcacgaaaaccgcgaacgctatcactgggcgagcgaatcttttcccgcctccaatatcagtctccgttcggcgtcacaggaaaacgtggtcatcgttgaccggtcagagacggctgatgtaaaaatcatcggagaaatggaccgcttcagcgcgatgacgcttcttcatgatgaagcgatttatcttcatgaaggggtgcagtatcaggttgaaaagcttgattgggaacataaaaaagcgtacgtgcgaaaggtcgatgtcgaatattatacagatgccaatttagcggtgcagctgaaagtgctggacattgacagaacggacagcagaaagaaaacggccttacatttcggcgacgtcaccgtgaacgcacttccgacaatatttaaaaaaattaaaatgacgacatttgaaaatataggatcaggaccgattcatcttcctgaagaagaactgcataccagtgcagtctggcttgaattaaaagaaacggattcggaaatcggcgaaaaaacgcttgaacagctgcttttaggcattgcccacgtcctgcagcatatcgtgcctgtatacgtcatgtgcgatcgaaatgacgtgcatgtcgtgccgcaaatcaaagccgcacatacgggacttccgacaatctttctgtatgatcattatccgggcggaatcggacttgccgatgaagtatataaacgatttgatgaaatcaatgaaggggctgagcgcctgatccgacaatgtccatgtcaagacgggtgtccttcctgcatcggctccgaaatagaaggaatagatgcaaagaaagcgatactccggctcttgaattacgtgtaaaagaaaagggggacgaaagatgtccttgaaaaataaattaaagcggatgaaaaaccacctgaatgtgccggaagctgaaaaaaagccggcagcttcacaactttcggtcccggatattcaagtcccgtttagagaagaatgggaggcattcggagtgaagcctttcttttttgaggatgaatactgtcttatccgcgaaaccgtctatccgctttcgcaccgccacggacggtacagcttcagtgaacttgatgacgtcatggcattatggaataaaggcggtttgacacatactttatcagcagaaggatacgaaaaaagccagctgttcttctttgatactgaaacgaccggcctcggcggcggggcaggcaatatgatctttttgctcggccatgcaagagtgtatgaagaccgtgtcgcggttaaacagcatctgctccctaaaccgggaaacgagacagctctttacaaaagctttttaagtgaggttgacattacgtcccttgttacgtataacggaaaagcctttgactggccgcaggtaaaaaccaggcatacattgctgcgggacaggcttccgaaacttcctgacttcgggcactttgatcttctgcacggggcgagacggctttggaaacataaattagagcgtgtatcgctttcggcggttgaaaatgaagagcttgcttttaaaagggacgaagacacccctggttatttggcgccgatgctgtattttcaatttttaaaggcggaggacccggctcttttaaagggagtgctctcgcataatgaacaagatgtgctttccctcatcgctctttacatccatatgtcaaaaaagatttttgcatcttctgatcagacgtcagaacgtcaggaagcatacgccatggcgaaatggtttatcgctcataaagaaaccgatcgcgccgttttgcagctggaagcgctgcaaggcaaagactttgaagattcggatcgggccctttttgacttagcgatgctttataaaaaacaaaaccgcaggcaagacgccgtgcccctttgggagaaactgacggactctgatcttcacacatgcagacaccaatcagcggttgagctggcgatctattttgagcaccatgcaaaagattacaaaaaagctctgcaggccgcgcagcaggcggcagaagacggggaaatatcggaaaaagaagccgagaagctccatgtgagaattgcccggctcaagaggaaatattcctcttgaaatattgcccgggaaagcgcaaaagccgagctgtttcgccaaaaatatttttttctgaatccgcatcgattttgttgtagaatggtgccgcatcttgtaaaatagcgttagttatttataggggagagttggtatgtataaaggtgttttttacttgttctttgtcgtggtttttttgattgcgtttgtattttcgaattttaaagacagtttgctgacacacttttaaattgggtgattgaattagaacatgcaccctcttttcttcataacctaacagtgtaataaaagttaatggagaggggatttagcatgtttcatcatcattgttgcagaccaaacgtgatgccgccgattgtccatccgactcattgctgtgaacaccattgcttttctaacacggttgtgccgcatattcatccgcaacatacaactaacgtaaatcaccacaactttgagcacgttcattactatccgcacactttttcaaatgttgacccgacaactcaccagcattttcagtgcggaagcccttgctgcgatcattagtattgaacgcttaagcaagatcggttaggatatcagcaaatcaaaatggggcccgatggggagccccattttttaagcaggtgattaattgaaagtattagccgtaacggggtacaagccgtttgagctcggtatctttaaacaggatgaccgggcgcttgtttatataaaaaaggcgatagaaaccagactcagaagctttattgacgaaggcttggaatggattctcatatccggacagctggggactgagctttgggcggcagaaacggcgtacgatctcagagaagagtatccggaattaaaggttgccgttatcacgcctttctacggccaggaggaaaagtggaaggagccgaataaagaaatgtatgaagcggtgcttgctcaggcagattatgaggagagcctgacgcatcggccgtacgaaagtccgctccaattccggcagaaaaacgcgttctttattgaaaagtcagatgcgcttttgcttttatatgatccggaggtggaaggatcgccgaaatatatgctgcagcaggcagaaaaacgccgtgaaacagacggatatccgatttattcgattacgatggatgatctccgtgccgccgttgaggaagaagatttctttacataacacgtcagagaatatttgacaacgggacgtgtttctgaataaaatataacatgatgattcacgatatgaggtgaaaaagatgcttgctgataaagtaaagctttctgcgaaagacattttggaaaaagaatttaaaacaggcgttagaggttacagacaagaagacgttgacaaatttttagatatgattattaaggattatgaaacctttcatcaagaaattgaagaactgcagcaggaaaatctgcagctgaaaaaacagcttgaagaagctagcaaaaaacagccggtgcagtccaatacgaccaactttgatattctgaaaaggctgtccaaccttgagaaacatgtattcggcagcaaactttatgacgaataaggcagatgcacttgtcaaatgagacaagttgctttataatgaacaagtgttcttaacgttcgggtaatcgctgcaggtctttgaatctgtagaggaaagtccatgctcgcacggtgctgagatgcccgtagtgttcgtgcctagcgaagaaataagctagggcagccttgataggctgacggcaggaaaaaagcctacgtctccggatatggctgagtatccttgaaagtgccacagtgacgaagtctcatcagaaatgttgagagtggaacgcggtaaacccctcgagcgagaaacccaaattttggtaggggaaccttcttgaaggaactgaacagatagaaggacagaatactttctgtagatagatgattgccgcctgagtacgaggtgatgagccgattgcagtacgacggaacaaaacatggcttacagaacgttaaacattattgatatgacaaattagagctctcctttaaaggggagcttttatcttgaatgaaacgaaagcttaaaagagacagggtgatacgatgaagaagtacacactaatagcgacggcgccgatgggaattgaagcgatcgtcgccaaagaagtgcgtgatttaggttatgaatgcaaagtagacaacggaaaagtcatttttgaaggagatgcgcttgcgatctgccgcgctaacttatggctgcggacggctgaccgcatcaaagtacaggtcgccgagtttcaggcaaaaacgtttgatgagctgtttgaaaaaacaaaagcgattgactggcgcgcgtacattccagaaaacgcaaagttccccgttatcggaaagtccgtgaaatcagtgcttgccagtgtgcctgactgccagcggatcgtcaaaaaggcgatagcgggaaagctgaaacttcaatcaggaaaacaaaatgaatggattgaagaaacgggacccgagtataaggtggagatttcccttttaaaagataaagccgtacttacactggattcatcaggaacaggccttcacaaacggggatacagggttgatcagggcggagctccgattaaagagacgctcgctgccgcgttaattctgttaaccaactggacgcctgaccgtccgttcgtcgatccgttctgcggttccggcacgatcgccatcgaagccgctttaatcgggcaaaacattgctccgggttttaaccgtgattttgcttcagaagactgggaatggatcggaaaagaactgtgggacaaggcgcgccttgaagtggaagaaaaggcgaactatgatcagccgctgcagatttttgccagtgacgtggatcaccggatggtaaacatcgccaaagaaaacgcagaagaagcgggacttggggacctgatcgaatgcaagcagatgcgagtgcaggattttacgacgaaactcgaattcggcgttatcgtcggaaaccctccgtacggcgaacggctcggcgaaaaaaagcaagtcgagcagatgtataaagaaatgggccgggcatttgaatctcttgatacatggtctgtctacatgttaacgtcaaatgaacaatttgaagaggtctacggaagaaaagcaacaaaaaaacggaagctctttaacggttttatcaaaacggattattatcagtactgggctaaagtgcggccgcagcggaaaaagccgcaacaaagagaagacgcctgatacagcgtcttctccggcatctttacgttttattctgccattaccagcggtgcgcttttgcgttgctccgtaaaataatgttggtctgggacatttcggtgtggccgttcacctgcgatttagagcgtttcggccgcgtccaattgtgatgaaacaattcagaatgctgatctaatcgatctttataactcatgtaaccatcactcccggatagaataattttgtgaagatggatattcgatcgaatatctgttgtagtttgtgcaggtcaggtgcggatcattcaggatggcatgtatagaaagtgaagcatcggcatagaatgatgattatttctatttgagaggtgatcttattttatgctgaacagcgagcacttcagtaaaatacaaaaggcgttagacgcaactgctttccggctggaggaagccggagctaagttcggtccttccgtcatgacacacgcacaggaagaacttgaaaatgcggtaaaacatacacattcaacagaccatccgttcctatgtacacatatcattaaccggaaatgataatgacaaaaacttggcgaggccaagtttttttgttgtattgaaaagggttaaatgatattatagatggtctgaatgccgaatagttaggggttggagttgggtgacaacatcacgtttgccttttgctttaacaaaagaaaagaatttttacgaagaattgaacaattggattggtgacgtgttttacgatatccttcccgagaaaggctttgaccttcgggatgagcaggtatttatggcgtttcagcttgaacgggcatttaaagagaaaaaggtcatgttcgctgaggcaggagtcggtacggggaaaacgctggtgtatctgctgtttgccatcagctatgcaagatatacgggtaaaccggccattatcgcatgcgccgatgaaacgttaattgaacagcttgtcaaaaaagaaggcgacatttccaagctgacagaacatttggatctgcagattgatacacggctgtccaaatcccatgagcagtatctctgtctgaaaaagctggagaaaacgatgcagcgttctgatgatgaaaagtggctggatctttatgagtcgctgccttcattcgtacacgaatcacaagcgatgcagcgcttttatccgtacggcgaccgcaaacagtacgctgatttgacaaatgaagagtgggcaggcgtcagctatgattccttccaagattgtttaacatgtgatatgagacatagatgcggtttaacactttcaagagatcattacagaaaatcaacggatctgattgtttgctcccatgatttctacatggagcatgtatggacggaagaatcacgcaaaagggaagggcagctgccgcttttgccggatcacagcgccgtcgtgtttgatgaaggacatctgctggaattcgccgcgcaaaaagcgttaacgtatcgtgtgaagcagtcgacgcttgagctgtttttagagcgtctgcttcaaaatgacatcagagaggaattcgccgaactgattgaagatgcccttgccgcaaacgatgagtttttctatgtgctgtcagaggaatcgaaggaaatcgccggctctcaccgattggacatccaaaacgaccagcgtgttaagcgtgcggctgacgaactgtgccgtctgctcgataaaatcggcgaggcgctcgtatttgaatcggaaatgtatacgattgataagtacgagctgtcagttgtagaagaatacgtcgaacaaatggcatattcgctgtcgctgtatcaaaaggatgccatcagctggcttgaaacgcgggatacagactcaacgtttgtcgttatgccgagaactgtagccgaagttttgggagaaaaggtcttttctaaaaagataccttatatcttctcatcggccactctttctgagggcggttcatttgattatatcgctgacagtctcggaatccgtgatcctttatcatttaccgttgaatctccgtacgattacgaggagcaaatgtctgttgcgcttcacggtgacatgacgtctgagcagaaaacagtcgaaacgattgaaaccattaaggagaatgaaggacgcaccctcgttcttttcccttcctttgaagacatgaaggaatttaaagaacaggctgccgcgtgggagctgccgtatccgatttactacgaaggtgacgaagagatcagcagtctggtcgaaaaattccagcgggatgaagaatccgtgctttgttccgtccacttatgggaaggtcttgacattcccggtgactcgctccggaatgtgaccatttgggcattgccgtatccgcctcatgatcctgtgtttaccgcaaagcggaacggagcgaaaaaagatccgtttgaggaagttgatctgccgtacatgcttttgagagtccggcagggaatcggccgcctcatccgttctaatcaggacagcggaaccatatccatttatgcgggcggagaaagtgaacgggtcctggccgaagtcaaaaaggtcttgcctgttacaccgaaaatcgtataaaaacaagagctgcaggaatcttatcctgcggctttttttaatccgggaagttgactttataacggcgttccattagcctgtaattgatagtgaaaagggaggggaacggatatggatgtacatacatatgaaaaagagttttttaatctgttaaaaagagtatcccactatgaagaagctattgcgctcatgcattgggacttaagaacgggagccccgaaaaaaggctctgatgaccgggcggaaagcatcggacagctgtcggctgacgtttttcaaatccagacatccgaccggatgaaagagctgatcgacatccttctcgtgcatgcagaagagctctctgaagatacagtgaaagcggcggaacttgcgaaaaaagattatgatcataataaaaaaattcctgaagatgagtataaagaatatgtcattttaacatcgaaagcggaaacggcttgggaggatgcaaaggcggcctctgatttctctatgtttgctccgtaccttgagaagctgattgattttaataagcggtttatttcttactggggctatgaagatcatccatacaacgcattgctcgatattttcgaaccgggtgttacggtaaaggtgctggatcagctgttttctgaattgaaggaagcgatcattccgcttatcaaaaaagtgacggaatccggcaataaaccggacacttcctttataacgaaaacgtttccgaaagaacaacaaagagacctctccttgtatttcttaaaagagttcgggtatgattttgacggcggccgcctggacgagacggtgcatccgtttgcgacgacaatcaaccgcggcgatgtgcgggtgacgaccagatatgacgaaaacgatttccgcacggcgattttcggaacgattcatgaatgcgggcatgcgatctacgagcagaatattgacgaagcgctgagcggaacgaacttatctgacggtgcatccatgggaattcatgaatcccaatcgttattttatgaaaactttatcgccagaaatcaacatttctggaccgcctattatgaaaaaatggttgaggcttcgcctgatcaatttcaagatgtgaaaagagaggactttgtacgcgccgtaaatgaggcgaaaccgacctttatccgaattgaagccgatgagctgacatatccgcttcatattattatccgttatgaaattgaaaaagcgattttcagcaatgaagtgacagtggaagaactgcctgcattgtggaatcaaaaatatcatgattatttaggcattacgccgccatctgacgcaaaaggcattttgcaggacgtacattgggcgggcggcgatttcggctatttcccttcctatgcgctcggatatatgtatgcggcacagctgaagcataccatgcttgaggatctgcctgaatttgatcaattaatagaacggggcgactttgagccgatcaaacaatggctgacagaaaaggttcatcagcacggaagacgcaaaatgccgcttgacatcataaaagatgcaacgggagaagaattaaacgttcaatatctcattgagtatctcgtcggcaaatattcaaatttatatttataaacgaaacgcccggcatacaccgggtgtttttctaaaaattctaaaaagacgaataatcgaaaactaattctttgtaaaagttcggaaatattcaaatttcactatgcaaaagaagtgtatcttgttataatttgattaatatcatacgaacactcatataatcgcgtggatatggcacgcaagtttctaccggtcaccgtaaatgtccgactatgagtgagcaatggaacggctttattcggccgttacgtgtagatcattcggcattgcttgctctttttttggagagcgggcaatgctttttttattttttataagcgggggtaatcattgtggaagcattaaaacgaaaaatagcagaagacggaatcgttctttctgatcaagtgctgaaagtggattcttttttaaaccatcaaattgatccggttctcatgcagcagatcggccgggaatttgcgcggcgttttgaaaaagacgagataaccaaaatcgtcacaattgaatcttcgggcattgcccctgcggtaatggccggccttgaactcggcgttcccgtcatctttgcgagaaaaaggaagtctctcacgttaacggatgatctgctgacggcgtccgtctattctttcacgaaaaaaacagaaagtcagattgcaatctccggaaatcatctctcgaaagaagaccgcgtgttaatcattgacgactttttagcgaacggacaggcggcagaggggcttttgtccatcgtaaaacaagcaggcgcagcggtttgcgggatcggaatcgtcattgaaaagtcatttcagccgggaagagacgagctggtaaaaaaaggattccgggtcgaatcactggcgagaattcaatcgcttgaagacggaaaagtgacatttgtacaggaggtccgttcatgaaaaacggctatgccaaaacactttccctcggtatccagcatgtgcttgccatgtatgccggcgccgtcgtcgttcctttaattgtaggagcggcactgggactgaacgcagaacagctgacatatctcgtatcaattgacatttttatgtgcggggcggctacgctgcttcaagtatggaggaataaatgtttcggcatcggcttgcctgttgtgctcggctgtacgttcaccgcggtagcgccgattatttccatcggtaaggagtacgggatttcagccatttacggaagcattttggcatcgggtctgcttgtcattctgctgtcatttttcttcggcaagctcgtatccttttttccgcctgtcgtaaccggatctgtcgtaagaattattgattgagtacgacataaacctagttatagtagaccttgatattcaaattcttcgtaccatctcccaaatcctcgaccgtatacgttacatgactaatgagcatctttagtattaagtttatttcagagttagacatcccctcagtagactcaatcatctcctgcactttatgatgactccatttttctttttttgtctcagcgctaagagcattttgaaactcagtagatgcaattaattctgctaaatcattttcagctttttgaagtgtctcttgtgaaattttcagcttttctttgtactctgttttactgatgtccccatctaagtacatttcctttatgcgttctattcttccctttgcctttttaacagctttttctcttaaaccaataagctgagttgtataagagtcatcattaacatcttgctcagtaggggagaagagagcttcattgtatttttttatttccttcataattgactggaacaatacttcttcatgaattccttttgtttcttcgcattcttttgttctttcagcagattttcgtaaacactttctaacgtgttttcttctgcctttgggttgttctatagcttgtgctttatgacaataaggacatctaacaataccagaaagcctgtgggtattcatatttaaacgtcttccagccactttatatgttctaagtttttctattctattcaggattagggcatgttcttcatcggttttcatggtttcatgatgaccttttgcaattaatacttcatctagatttttattttgaacaatactgttgttgcttttgcttttcttgtatttaccaaaccatacataacccctatgaaaatcgttggacagaatttctgaaacaacttctccgtaccaaatggaacggccggatggggaagggactttcagttcgtttaacatctcagcaattactgtgcaagaatattcctcttctaagaaccatttaatcatcattctatatatttttttcttttcctcaacaactactgcagctttgagattcttgtcccacttataaccgtatggaacagaccctgaatgcagtctgccttctcttgtggcatttttctttccgttaatcgttcttcgttttattgctctatattcacttcgagcaattattgattcaaactcagaaagcatttcgtcgccttcaattgataaatcataggttttttttggtgtaataaacaatgttccactctgcttaaatgcttcaagtatacgtcctgaatcaatttgtgaccccctagagagcctgtccattgctacagcacaaactgcatcaaactcaccattttcgattcttggcaataataatgagaacattggtcgctcatcaatagtctcacctgaaacaacttcttcaaaccactgaacatttttaaagttctctctttttatgagatattctagctcatttctatgtttggcgagtgtatcttctgaatctctgtcttctctggattttcttgaataaactgctattcttgaattttcgtgtaacgccaagtatttcatcctttcttcttattgtaagtgtagttagattatatcatgtgcattggaatttctttataaaatcctcattttaacgaaacattttagatcagcttgcttattaatctaatttaaagtatcctaattgatgtatcataggggtttaacagccactatagaccacagagtccctcacagagctctgtggtttttatttagatagaatatacccaaataaaaaaagaagcctcagagggcttccgatggattaattcttctcacatgcaaagttgtcattatcgcgatccatcttagatgtataagcagggtgagtgcttggtacgccatgcgggtatttctttctcagctctgtgcagtttgcaaagtgttctgttcctccagcagaaggggaggcttgtgcagagttagaagagctgcttgatgctgaactgcttgaatttgaattgctagggttcgatttatgtgtctcggattggtgtgttgtaactgacttttgaaccggcttagatacacttactgatttcttcggtttcgttgcgcagccattaaatcctttatcagtcgcatatccattcttactccaaatcttcaagtctttatctttcgcagcttgctcatctttcttatacgtgtctaaatacttcgtgtttggctcatatacataagctactcgtgctaatccttctttaagcagtgtttcttgtactgatttgccatctgcgtaaacgtaagccaacattctgccatacttatctgtgcgatctcctttatcaaactccagttgaagcttgccctcgttaactagctgtttatttcttgctgaagcatcctcaccatatggttgtacgcaagagtttggtttcttagtttcaggagtgtcaacaagcaaataacgaactgttttgacttcgcctttatagttaactttaatcgtgtctccatcaaccgttctgttaagtgttacatcgactagctttttcttattgtcagatgtctttttatccgacgaatccttctttgaagcattttcggctttttcattcttgtcattattgcttttgtcgtttgattgagagtctgtctttgtctcttttgtatccttttcttcttgttgcgttgttttagccttatctgaatctgttttatctgtagaagcagaatcagacccacatgcagccaaagaaaagcttagagataatgcgccaatacctaacaaccatttcttcaatgtaattcccccaaatttgtttgttctgtctctatatcggacaaaccttcctaattataaatataaaaccaaagattgtaaatttgattttgtcattttaaaacactcaaataaagttgtgtggtaaaatttagtggtctaaaccttagaggagggaaagttatatggaagaagggaagttaattcaaatgactcttaatggaataaaggaagctgtttctaaatacggaacattccctatgtttcatcatggagggtatgtcatggaagatgctacttttcatttcaaagatcctgctagtcctcaagaaattagcgatatagaacagaagctaggtgttaccttccctaatgactataaagagtttttgttacagcacaatgggatggaaatgtttgatgggattgaaatacttagcttagagggaatcattgaatataatgaggttcaagatttcccagagggatacgttttaattggatatcattttgatggaagatatgtcatagacacaaacaaatcaaaaaatggattaggttatatgctatatctagactcaattgatgatattgaagatgcgattaacttagattcgaattttgaaatatggtttgatatgttagtttcttccaatggaacgaaatattgggaagtgaatccgaatatccgagagtattataaactggtttcagaataaaaagactccgcataggagtcttcatctacgttcatctacaattttacttcttttttgtataagaagcccaccatggatttacttctttcctgtgaaaattcacatcgataggaattaaattgcttgtctgatttcctccaccgtactctctaggtagttgatgatgaatctcaaatttcacccaagtttttttgccgtattttttatcataccatttcctatatgctttgcgttctgtagttccccattttactcttttatcgctaggcacccatttaataaatgcattaggtggagctaatatatttaatcctgattgcttatctgtgtaattggaggggaaaaacattcccttcatattcgttaggtataatccttcagtccaggatatcgttctaacagttggttttttccctgcccaagtagcaattgcgccgccagtatacttccaaaatgttgttttgtttacattaataaattgatgaacttccgatccctttttcacttgaggccctacaaaggtctttctaatagtatgggggcaagtaaactgtttattataataaccacttttgcataaaccctggtgtacttctgctgacgcaggaggaatccctactatttttgaaatttcaactccgtgcatcactttattaacttttccacctaaaaaagtgtgactgaaatagataatactttttgcttttttctcaacagttttccgttggttttcagaggtgacttgtccagatgatgtctgattaccatctttgtcataagctatataagtctgatatgaactttcaacatccattccttgttccttagcaattttttgcaacttactttctgatccagctaattctcttttagaggaatcggtgttttgcggtttttcgtttactgttgagatacgtttgtttaggtcaatgccagttgcattattatcagtgatttctttgtttgccgttgcctttacatcatggaggggatagcaagagaataataaagagagagctattacaactaaccaaatgctttttgacacatacttcataatggtttacactcctttttcttctgtttaaacctgctatgagtatctaagatgtaaataaataatatattttacaattaatacctccttccgcgaggatagtatcaccttttccattttttatcaactgaattaagcctattttaagattttgttaaagttcaaatctcctaagaaagagaccttcgacaaaaggaagaagctctccttacatgtaattttatgtggtaaaatttagataagattgagtgggaaggagacagatatgaaggtatttgaagcatcctcgttaatctcagcagcggaaaagcgagcaaaagaatacgatcagattagagaacaatttatcaatctcagaaaagcatttcaaggaatggctgatttagatgacagcgagttttcaggtaaaggtgctgataacattaaagcattcttccaagatcacgctggtgttacagacagctggcttgatctgatcgatatgaagattgcttttcttaacagtatttcaggaaaagtagctgatgccggattagccgattcgtttgtggaagagtcatttttagagcatgagttgattcatgcgaagaataagtcaaaagccatcatgcaagagcaacggaatgaaatgagggatattcttaatgagataagtgatattgttcatcttgatgttttctctacagaggatgtcgatcaaaagctggattcagcagataagaaacgggacaataccatacacaagctcggaaagctcgatcatgatctaacgaaggaatatgcagaaaccgaagcgaacgagcatttcatccaagccgactttcaacagcttcaaaatgccacgggtaaagggaaaaacgcaacaccacttcactataacgccaaggcgtacagagaaagtgacatacataagaaaaaaggcgagattgcaagacattcggatgcttatttgacgattaaaaaggaagaagcgaaagagcgggaaatcaaggatctgaagaaaaagctcgctgacggtgtgaccgatccggatgaatatttagaaatcgcgaagaagatcggctatgaaaaccttgaaccttcccaacaacaatatgtgatgcagcttgaacaagcaaaacagatggaagaagccggagaagtgacttgggatattttaaaaggagccggcgttggtttatatgatgtcgggaaagacacggtaacaggtttatggcagctgatcagcaagcctgatgaagttgttgaaggtatcataggggcagttgctcatccgattaacacgtataattccatttcaacagctattgaggaatcgtatcaaaaagatatggtaaatggagatgcttactccagatcaagatgggtgacatatgcgataggtacggtagttacctctgtagtaggcacaaagggagccggttctcttacaaaagctgacgtagcaggaaaagtcacctctaaagtcagtaaagcaggccaaaaactgaaagatgtctcaattgctgatttattgccttataatccacgttacgatgttgttccggctggaggagttccttataatgtagttaacggtgagaatttaaaggatcgtctgcttcagttaataaagtccgccaatcctagaacaaggttgcctagaaatcatgggagatgggaagggactcctggtaacggtaaatggcactcagatagacctgacgttaatgcagttactaaaggagaacccgtcacttttatagatggcagaccggtttttacaccatggagcaaagggacgattaagtttaaatcaggagaactgaaaggtactaaaaaggattttccagcagtttataaacgtattcaaaaaatgaaaggctttaaaacccaaaaagaagctgaaaaatggctgaaagaagtagttagattaacaccgcatcatttagacaataacaccatccaattaatccctatggatttacatggtaatatacctcacgtaggttcggcatctgatttaagaggaggattttaatgggtatacaggcaatcaagaaaaaaatgagtgaattttatttagatataagacttgataagaacataaattctcatcaagtccttaaaaagtttgaggacgaaaattctttcgacataacagatgaatataaagagtttctcaatttatacggggaatgctggatagaggaagataatgtgtttttccctgttttagaggacaatccactagcagataacggtaatctccggttgggatatttctacggtcttaataacaatgatgctaatattatcaaattaaaagaggatctttcagaacaaatgccggactggattataccgattgctgatggtgacggaggagatcaaatttgtcttggtgtgaaaggagaagcaacaggaaaagtttatttttgggatcatgaattgacaaatggaataaaagacacatttttggtcgcaaattctttctctgacttcattcaaagtctgtttattgaagagacaacagatgaagacgatggtattttatctattgagctagatgatgatttattaaacagttaagcaaaagtattgcaattgcatgatgtagcagcataagtgtccttaggcaaagtgaaagtggtttaatccataaagcaatagtattgcaaataccatttttatgtggttataattagtgtagatgatacagttatataattattttttgcatttgatttgtggaaatgcataaaataaaaagaccagggtgttggtagcaccccggctctgtacaaaaagctgcccatcaaagggcttgctcagcagttgttcatgataggcctaacccttcaggtttccaggctcaagggaggtctattttttatttatatacgtcaacagggcgattataaacgacccgaatgcaagcattaacattaatgcctgaaatgttgacataagcatcaccccctttcgtaggggatgagcaagactcccttgagtgagcatgctttaatgtacaggaatcattatacactaattccaaatatatgtctgtgattattggagccttattgacaatagacaagttataatgtagtacttttctttttgaaatttgtgttataagatatattaagattttcaacaagagaggaaatttatcatgaagaaagaaattttgctaattcataatggctcaagcattacatatgcagacccacatgaagctgctaggagttatgctaaagctgtcattgatggggtaaatcctaatgaaatagaactatatactgacattgccgtaaatcttaaagaccaagctaaactgatgaaacaatttaaccaggaactatctaagattgtaaatacaagaattcctatgatggaagaaaacacaaaagagctaagcaatgaaatggaaaattcacatcaaatttataagggaatttcaaaagaaagcataaaaagaaaaaggattagaaaaacgaaaataagcaggctataaaaatagcccgtcatttgcgtgatcagaaagaaaagcaatactttgtgccggagtttttaagtgtgaaaataaattactatgtccccccttacaagcatacattgtgatatgtaaggggggatttttcttgcctagataccggagcgctcttcgcaagagagggcctttgccttttcggtatgtgttgcttctgtcgtttgctttttttatcatatcgacggtcatcagcctctggatgatcaactcctcaatcaaaccggtgctgatgaacataggagaaatggaaaccaaacgggtggcgacagaggtcattacggaatccattgaagaatacatgtctcacagcgacaatgtgaaagatatggtcgatatgaaaacggatgaaaacggaaaagtcacaacgatggattttaatacacaaatggtcaacagtatgaaggcgaaagtgacaaagcagcttcaggctcatttgaaggaagcggagtcgaacaataagcagcatgaaacggaaaaaggcgcgaaaacggccgatgaaattatgattaacatccctttagggcaggtcacgggaaacagcattctcggaaatctggggccgaaaatccccgtgcgctttaacctgatcggtgatgcgttaactgatgtgaaaacaaaaataaagccgtacggcattaacaatgccctgatcgatatcagtatttttgtggaaattaaagtgaaggtcattattccgtttgccagtaaaacatcagtcgtgacaaataatattccggtctccattaaagcgattcaaggagaggtgccgcagttttataacggaagcggcggatcaggtgtgacgccttccatccagctgccgaatgaaaaaaaggagaaagacaaataaagacacacagccgcattttcttctggcggctgtttttactttttcctgcggatttcttgaaactgaactcaagtatcgactagagcagcccataaagcttagtggatacttgctgaatagtcatttccaacaattacatcgaactattgttcttatttatattgaataaagaacatttgttctgttaatattagatcaataaaggagtgattcaaaatgcttagagatcgaggggcgatcaaatggacttccatgatgcttccagaacatttaacgcaattaaaacaggacttgttagatgtttcgaaaatggagaagccatctttagatgagcaacaaattgaggagattgacatcctggtttctgaagcaatggcgttgaataaagaactaaagtttaagctctttaaagaaggggttgctgaggatttaatcggtacagttcaatatctcaattacgaacaacacaaattacacgtaaaagatcatcatgatcaaaccgtatacatcaccatgaatgacatcataggagttgcttacaatgattgattactcacagtttccacgtaaaaatatactttgtgtagatatgaaatccttttatgcttcggtttcagctgtaacaatgggattgaatccaatgacatgttatctcgctgtagtcggaaacacggatagacagggaagtgttgtcttagcagcgtctcctgcacttaaaaaagattatggaatcaagactggctcccggttatttgagattccagatgatccaaaaattcatatagtaaacccgcaaatgaaacttttcatcagagtttcaactgaaatcactaaattgttttacaggttcgttcctgaaacatgtgtgcacacgtactcaattgatgaatcttttttagatgcaggaaaagaaaatcctgaagtcatggcagaagcaattcagagcagtatgaagagagagtttggcttagtttgtactgttggtattggtgacaatatgttgctgagtaagttagctcttgatttagagagtaagaaaacaaagactgggattgcacggtggagatatgaagatgttccaaataagctttggtgtgttcatccgttatctgaaatgtggggaataggagggaggatggagaggaatttaaaccggatggggatttcaactgttggtcaattagctaaatatccattagagctacttgaaaaacgattcggcattatgggcaatcagctttattatcatgcacatggaattgacctttctgaaattggagctcctttgatgcaagggcaaataagctacgggaaaagtcagatattacttagagactatacgaagaaagaggatatcaaggcggttctcttggagatttgtgaagaggttgcacgaagagcacgaacacataacaaagtagggcgcacaattagcttgggtattggttacagtaaagatgagttcagcggcggctttcacagagctaaaacgattgatttgcctacaaatatcacaatggatatttatcgatattgcttgatgttgtttgataaattctatacaggcaaaacggtacgaagtgtttcagttaccttatccaatattgaggatgatgtaaatcaacaattaagtctgtttgaaaaagataatgagaagagaagaaagcttggattcgttatggacgggataagaaacaaatacggatctaaagcgatcttacgagctgtttcttatacacctggaggcacagctttgcatagagcaggtttgacgggtggacataaatcatgagaacagagagcagctccctctgttctccttacaaagtcattagttttttacgtttcggctctttcagcaaccttgaacgtatcattttgttgttggagataggaagcacccactgttccggcaacgccgaataatagaactgcacagataaatagtttagttttcatattgcttctccccttttgatttgtcttcttgcttcatttgccaaacgataaaattcaactgcaccccaagcatcctgttttccagtgagaaaatctgctacagagacaccatagctttccatgtcagggtatatacttctttctttgaagaactcgaatgttttcctaactaagtctaaatcatagtccaagaaaagtcctttaaccatttttaacttttcaagtaccatttcattgttatgccgttcagccaactgtttggcctgttcataaaatttttttgcgttttcaatgtcattttgccttccctttaagaaggagataacaaataatgttttagcagcgtaatcatgattttccggctcaatgatttgaagtgacttattaaagtgaaaaaatgctttatcaagttcttccatttgattataacataatccaatattaaacagtgctgaacgcatcaaatgcccacgattcttttcacttttgtttagctctactgcttcctgatacgctttgtatgcttgctttaaagcttcatcaaacttcatactgtccaataaattaccaaatatgacgaattgacagcgtaccttttgtaccccgtatgtagggctcccgtcaatagcaggttgctttttaaatatatcgtaagccctcatggcataattcattgaaaaataagtctgtttcatgtggtaatacacttctgacaatttaaaataaaattcagctttttcaacttcaatatcttcgctctcaattgaatccaaatatctctcagcttgtctatagtgattaagggagaatgccaactccttttgtctaaaatagaacatgcccatgaaaaaataatagtaatattcgagcattccagttaagttttcatggccttcgtatgcttttaactcaccatagtttttctcaatgtcttttatagcgttaggatacatatatgccaacattagcttatgtctaaactcaagtagggagtagtatagtaaaacatcttggttttcttccataatttttatttcctgcataacttctttacgcatttcttctgctctaccgacccaattctttttaatagccacataccaatgattcatctttgttgctactaaatcataaggaatgaccttttcgttctccaagtcctaaacccctttcaaatccattttattatatagttgcattggaggaaagaaatgtaaagggaatttgagtgaaaattaaaaacaaatcaataattcgattatgaacgaaacgaaaaaaataccctcctcgttagagaagggtatatgatcagtttgctgttgcttttagagaagcaagccactcatctaatgttccagtgaagccttgttgaacggctaattcatatgctgattttccatctttaccggcagcaccagtagctcctttagcaccggttgcaccagtatcacctttgtctcccttagcgccagtagctccagtgttgcctttttcaccttttagtgaagctaaccattcctctacagttcctgaaaaaccattgtccactgcgatttcataagcagacttcccagtgacaattgagacattaaccattggattgaaaaaactcatttatgcgcccccaaaaagttatatgtaattcctgactcagaaattttgaagcttgtgataggtgaatcgtgagcgtccatttgaaagccttgtccagcccttaaatagataggatctccaccattgattgatacgtggcatttctgatcattcgaaaagctgaacttatagaaagaatatttaatcgtccaggttgcaggtggggaggggattacttcatggttagattctgacttctcaagcattggacttccgatatatccagatcctatttgcataatcaacaatcattcctttcttcttgaaaatgaaaaaaagggggagataaactccccaagttattttggctctgtgtattccatggcttgatcgctgtctgagatacctgtagtggttggatccactacaacccccattgcagttagaaatgtaagcaaagcattaaatttctcagtaagatcatcgctaaacacagaaatgtcgtatccaaatgcagatgcaattgcttgtgcaaacaaaagagttgcagagaagattgcaaccaggaatgttttctttttaagtcttactttccagttaattttagtcattaaatcgtctccttataaattagctaatttggtgatatcaacaccagcgatctctgcaccaagcagtaagagaataattagaactaaaatctttaatgtcttgccgaatgttccttctaataagttttgaagccattttgtttgcgactgattaacttgctgaaactcatttcttagtccagctatctcagtggtgaacaaattttttgtttcaacaaggtttttttcctgattctcaacaacagtggtaagcctaatgagcgattcacttgttgttttttgtgtttccaacatgatttttctatcttctgcttgttctttaagacgttcttttatatgagcgacctcggtctttaaaacttcatagttttctttttcagccacaatgcaatcatcctccataaaaaataggaggtaatgtcacatcacctcctaaataatcattgatacactttgagctacaatcattctcaaagatatttaaatatatttagatttttgagccaaattgtcctgagatgtagcctcgtttacctttgtagataacttcccagtaacccttagcattgtttaaccctttcactgagccagaaatgctgacggtatcacctagctccacagtgccgagattcttcgctttgtttttatcaggtctgtccattacgatagcagcgctttttactccgacaactttaatcttgcctacagatttgattccactgctatcaggcttagaagtgggtttaggctttggggttgattttccaagctcagcatcacttttaatgtatttcacatttacatatccgctgtatgtagcgcctttggagtttgtatatttgatataaccccaaccattttgagttgatcctttttggtattggacagtggagcctttaggaagggcaagtacaatagaggagttcgcattgcgctgagttctcacattaagactgtctgcgataactgtgttcttaacataagagccatttgttttaacgacttttgttggctttgaagatgaggaagaagttttcccgccgagtgctttcaattcagcagcaatagaagctttaacagcattccaacgtccttcatcaagaactcgatgtgggcaatacttgccagaccagtcttgatgctttttaactcgatctatgccccagccacgttctttaaggagttgtgcaataaacttaatagccaacgcttcagcttttttatagcgctctccgcctgatttagagtagcaaacttctacaccgatggaagtccggtttcctgaattcacacctgatccatcacccgtatgccatgcattacgatttgtaggaatcccttggacaacctctttatcatctacagcaaagtgaaaagaaacttcattattgttaccgatcatataactaacttcattttgcgctggtgcgtcgttgtatgtattgtgaaaagtgatgaatgaagcagataatgcatatggacatttgattgaatatttgtctggtgatactaacatttgtctcgcttgaatagccatattaaacatctctcctaaattaaatttgagcacaaaaaagagagaaggggacaaatccctatctctctttatctcacgtatgctcttgttatctctgtttttgaatgccgtaaattgaataaaatttatattttaactagaacataaccacctcctttaattttaagggttacttaattaagcagatggcaatgccgtaaccgagcttgtctgaatatggagttacaatctccatagccttccaagagtaaaacctgtcttctgattttgtgccgattccataattaccttcaattcgatctcccacagaaacagtactgtccactttcacataaacctgtccaagcaatcctactatattccattcaggacgttcttcacgagggacgtaatctattttttcaatccactcagggtttactttaggcagcttcttaacatcaccggtttctgggttgaccacatcttcatatatgtatccaccaaactcattctttaaatatctaccttgccagtgaatatcagctcctcctagaatagttcctgcagtttcagagattactccgtgtacatcttcaccttttctcgccgggcgaattttagctccttcaagagtgacaattgtccctgtcggaattgcttttccgtcaagactttcaaaatactcagcgtaatcactaaaggtggctccgccattcatctttcctgccgatgttatatccccattcatggagtttagcatccatttaatatttgctctggacggagtagcgccatatccgccaaccaccatatagcgatcattttcaccaagttttacacctccagaagcgtggatttcacgtgatacattttgcccctcgatatgagaatcattggagttgtaaacaccgctacgagatccatctacagagcttccgcctgatgagccgaaaacgttggttcttgttccctttgcaacgcatcctccggtagtagctccaactaaagtggcatctccaagtgcttgaggttcacccgatgaagctaatactgcactagtatttgttttagcatagccagaagtcgtagccccacgtagaccgcccttgaaattattcgggataaacgtgtaggtttttccggcaattttactgggagtagcgtattgttcacacatcgcagcgctaatattagcttgtgaattcgtgcagtaaacacctatcgaacctgctttgtttgatcccgtcatgttaacgttattgatattgactgagccaactttacttcccacagcaataccaactaaagcagattggttaatggttacattcgagatgtttacattatctgatttttgagctccaccgattacatagatatcgttactcgctgttgtaaatcccgaaacagtgatgttgcttaggttgatatttttgcttttatattgggtggtgatgattgcagtgtttttataatcataggttggatcaccaattgcgttgaagttcgaaacgttgacatttctataagcggaaatgactagtgcgcgaggatttaaaccttgataaaggtcactgaaaataggatgttgtgcagtgcagttaacgacattaatgtcaaatgcacttgtggagattttttcggaggctaggtggaagccaatatgtctaaagtcgaaagcgcggatatcattttcggaatagcagtttattaagtttacgtttcttgctgcaggtgctctattgtgagctttgacttcaaaacccctgcaattttttcggctgtaacagttcacaagccatacgtttttagagccatcatcaatttcaaaaccgtttgaatttgaagctcctttgctgtgtgcggatccattagcgtcataggcgtaacagttagtgaagaagatgtagtctgaatagtgagttgtgaagccatcatcaccatagttagttgcagtacaattttcaatccaaacatatttgctaccatttggctgataatgatctgctccatcagaagaagagttccaaacaggggagcttacatcaaaaccgtgtacacctggattacgagcattgacgtttctaacccgaacaaatttagagttaacaatccccacacagtttgcatttgttccatttgtaatggtgttgtcctttttgtctaaattccaatcgaggtctaagtcttcaattaagatatattcgtttccgtttgtgtagtcgctattggttaacacacaagatgttccggtagcagttgggtgaagcttgataatagatcctgatccaacaccgtaaagtctgacataagaagggatatgtaatccttgaaccatataaatacctgcgggtacaaaaacttctcgcttcccgctggcaaaggcagctttgaaagcttcagtgtcatcagtaacaccatcacccttagctccaaaatcctgaacattgacacttcgtctgataaactcatttaagactttatcaacaattgttgcaccagctgcagggatttttgaaatgtctccaatagtgtttgtgatatctgttaaaccagaatcgactgtgcttattacgtttttaatatccttagaagctttatcaaaagcctcttgaatatcgtctgcagtatatctaatattatttgattttaaccctatggcatcaatgggtatccattgctctgtttcttcgtccttatagcccattgtgtttacgggaattaaattgtcgctcaatatatactcctccttatccttttctaatccaaaccatgcttccgtcagggggttctacagatggttttatcctcatctttttgggagcattgttcgttctcaaccatactgatctgatgttgtaaggctctacatagctagaaacaatgttgaaaccatcatacttatctgacacgctaatatttatccagtcgaaaccatcccatcgatattcaatgcctgtttcttttacagtgacagtccaaccaatttgaggggaaggataagtgttcaataaatcctgataggtgtacacaaacggcaagtaaatcttcctagtattctcaactacatactcataatctgatgttgcttgtctgcaccaatttgttatttcaatacagcgcttggtgacacgttcacattcagcaatacgttcattgatacgaataatggcatcttcagcatcatcaattaagccttgaagcgtttcaatgaccatatttccttgtcgtttaatccaaattcttgaggcagggaagaaggatgcgccttctccttgatatgcaaaagtaagtgatttgccttcatttgaaccattgaaaaagacaactcccataaggtaatcaaccttaaagtagttgtcttctaattcaccatcttcaatttctcgccattctttactgtcaccactaacctcgactctgtactcacggttaggtacttctgtaagtaagactcgaccattgtaaacagttaaagtttcactatagcttaaataagggtcatcgattgaacccttccttttttgagaaagggtagggtcgttatagagctgaggaaaatccaaactaaattcaccgtcctttcttattgtgtaattgatttgagcaattcttctaagtgcgcgactctctcttctaaactctgcagtctgcccttagtaccacctaatgtttgtcctctaataatggattcagctttcttgtcaattacgttgtaaacagacttctcatctgaaattgcatatacagaatatccttgccaccaatcttgagcttgaaaaactctaacccatgcttcaaaccaattcgcctgaattgattcattgtattcccctaggtcaccgaatgcgttatggggctgttcaggagagttactgtaaggtgggatgccaagttcaccaaagaagatcggcttattccatttatcataaaatgctttgatttccttgaatatattttgtccgcgtccgtataacggtacgctataaatagcatcaattagctgatcgacagatggatttcgattatcagttaattcaaagtaagccgctattgcaataatatcgactagtccgaatagaggattattcagctttttgttgtaggcagcaatcgtttcgggagcccaatcagcggttacccaataatttgttcggtagagcatctttccactgaataaactcctaacgcttgtaataactgatttccacttttctgttgagtcttccatatgaactaggtttgaagcaatgtataaaccgtctaatttaaattgttcgcattttttagcgaagtcttgcaggatgttgttccatgctacgaaccattggtctagatcagaaggtgcccaatcggtttcagctatcgttccatttgcgatgaaggggtagggttctaaaataatgttgtacccgtcatttttgagtttagggatcatatcccacgcttcgttataagtgtaatccacaacagttggatttgagtctgaagcatccacagcattaataaggataggaatagtgattgtatttaagtttaaaacagttgagtcataactaacatcagcataatatttacgaccaaatgcagaaacatttccgcctttccatttcaggggattgaccaaaaggttattgagctcaatgttttggacacgactatcatagtcggagagtttagtgtcaacttgtgctgctgtggtttcaactaactcagcagttttctggtcactggaaacccatttttcgccgtcataagaggaaacaacaccggtaaccgtattagtccataaatcgtttgcttctggctcttcgggttcagttgaggagacagtgtatttcgagccattaagcttacctttgacttctacagtagaagaggggaggtaggggttttctgaggggaatttaggctgtacaatatcagatagtattcgaccactgctatcaatggacgtctctactgtgcgataggcttggactccaaatgtatagtgtttatttgaaacttgaccggttaatgttgcaattcgtttatcataactaactgataaatattgttcagctgacatctttgcaccaaaaagataggtatcatctgatgtgtcagagtagcaatggataagaaaaccatcgatattgtatttatcctcatcggagtctggaaaatcccattcaattgatacatctacagatccattatcatttacaacatgagttatagcagtcccgtcatttcggatagttgggtttgctacgggtgcagatatacgatcatttcgtgcattgtaattggtcagtagggtatcataatcaatctttttcttattgaattcagttgatgctttcttagcagtatacaatgagcgtgcaaagtcttgttctatcgtagtagctctttttccattcgagagtgttacttgtatactttgctgctcaaaatcaaaattcattcctgtaagtgttgctttgacatcagttctaaaatcgtcattaactaatctgattatatctcccaggtaaattctatcccaaaaatccttttctttgttgacagtgaataagttgacaatgtttgttctgatgtctaccggaggtgtatttttctccccaagttcctcaaggcctttttcatacagctctgtttcatcaaaaatgttgtcattagaccaatcatcttgacggataaaataagacaactttttcattagcttttcaccgagaaacttatccatagataaccgatcttttaacactgctatttcttcagttatcttggaaatctgattggcagtggtggatatttcagctttctttgatgtaacttcaagttgtttggcatctctttgcttgataaggtctttcgtgtcatctccagctttttttgctactgtgatcttatctaagatttgttgtaattcaattttttctagggtgaagagggtattctcctgtgttgtttttgttgcttccagatcttttttctgatttaaaaggaggtaaaaagaagagccttctttatttacaagttcattgtaatctaaaattgcatggcacaaatcatcatccatgtaatcactatgcttaattacatttctcttttcatcacgttcaaaagggtagaggaaataagagaaatcatccaagtaactttgtccagtaggattgactgaattaataacaattccatctttaccggtaatgtctaatcgtgttacaacttcatcaatatcaatggtatcttccatatcaatcatgaaccttttaggagagaattggacacctttatacttggacacagtttcttttttataaaatgatactgtgttgttcacagtatcaaatataggcacagcctcaaaagtttctccaatgttctttaaaaactcatatcgggtagaggtaacatcaaatgagcggcgtttttcattaaaagaggggtcaataaagtctacagtaaagcaagttcctttaagacaatctgtggcaacttccaacagatttttagagatgccttcatatgatttgattttgcttttatgaagaatgtagggaagtccttgagctctaacttgtattgtttgttcctcattttctgactttgtcaatccggttattacaaaccattcaactctgtttaagaactctgccttaatgagataccagccttttatgagttctgccacatggtttggcttcatcttgaaattatatcttgctttaagtgggatattaaaagttagatcgtggagttcatcaaaattcaaatttagagaggcgttagagaaatctactatattagcgattttctttttatttggttttgctaaagaaaccttgagatggcctggtttaaaatcgtaaatcaataaaacatccccttacaaatacttatatctgtatataaaccggatacaacattcgcccgttattttaactctgtttatcccccttgttaaaaaaacatactgttcattgacttgatcataacactcatacccagtaacactggaggtgatcagctctttattggcatctacattaataacttcttgatgtttaattgatgtgaattttagaggttctttataagctgtcaagttttcgactgtgatgtctccatcaccgatttttttgaattcaagagagagtgggatatctaaatcccctatatttttaatttctatattattagaacctgatgatatgtcataccaatgggtagttgtttctcgtccatacctataaggaaatactttcattgtcagcttcacatatccgtcattagagcagttgtgtaccaaatctgttgcattcactggcaaagcaaaataaatgatatctaaattactactgaatgaaagaggcttataatcatctacatttagccaacgtgcaactcttcgaatattttcttcatctaaatgatcttctatgtaaaagtttaaagggatttcatatggttcacgtttaacactgtctacatacggttcagaagctgatcgtgtatatgtttcatttactgttctattcgctacgaaggtctcttccaatagtccgccctctgtgtttacattcactgccccaatttcataagaggggatatcatcgaacatgaaatattgactttctctaatcataaaattccacccttaccaatcaaaaagcaagctgaagagcctgcattatacagactcttacatgcttccatttaattttataacttctttcttgatggtttcgagcattgttctggctccagtttccccaccagtaagtttatcaacattgaaaattattggtgtgttaattgttttatcaccattagaattaacggttgtggtagggggcaggttagcagtcttaacatttggtatcaaactattagataggctcgcttggttaatattcggaattattgatggaatagaagtaatccctttgttaatcaaagctgctaattttccaccttgcccccatttaggtgtttcattattcagatcgttatcagacagattgcgaacatactttacagtttcaagcatgttcttggtgtcagtcttattcagaataagctctttatcatgaagaatagcaagcttgccagcacctaaacctgttcctgtgtatcctcctgtttcaaatgaagatatttttttgcctgttgtattgcctttggtcacagtattaagggcattagaagcttctttaagcttatcgataaggttattagagatacttttaccaatggactccatattgctgttaatgaatttagagaattcattcagttgcttagcaatatcagtaatcttcccatccattagctttttctcaagttccttaaatccacgctcatcattgacgagatcatcatatttcttgttaattgaatcttcgtctttttgaagctgatcttgcaacgcttctttacgtttgctactttcacgatctttaagaaactcatctaaatctaactgttccttttgtaactgctcagttaattccttaacctttgacttaccaaattctgagtcatcaagagaatactgattaatttggtcagtgagtttttggatactctcttgcttctcttttaactgtctttgaaatttagcttcatcgtcagttttatcgatctcatcaatcaagtcttgtgttgctttttggtgcgcttttaattcaatatcacgcatcttttcgtacatctctttatagatggagacaacttcatcagcaagggatttgtacacatctttgattgatttctttgtgttgtaaagctccagattgtaatccttctgcttgtctttccagttctcgatttcttcagtaatttgtttctgaatatccgggaaccctttagcagctttcttttgtgcttccaactgttttatatacttcttcgcttcattctgttgctgctgaataagcttaatctgttggctataatatttaaccttgtctttatcttcctcggtcatggatattttgttgctaacatctttaagcttggattcagttttcttggttgatttctctataccgttaagcgtttcatcaactttggattggatgagctgtccctgaagttctcttacttcttcttggaaattgatgagatcaatcttagcttgttttaattcctcagcaagctgtgctctttgagcggcattcagagttttgtttgttttgatttctttttcaataaaagaaaccttctgactctgaatcttttgctgttcagttaaagcttttttctgatcgtttgtatacttacggaactctttactatcgctcagataatgactagcgagggctttgtctttagcgattcttacatcaaaatcaccaatgcgcttgtcatattcatcaagatgcgactgaacgatctcatattgaagctcttgtatctgatcgtttactgaattaatgtcaccttgaagggagaggaggtcggatttagcttgcgctattgcttgttgtcgttctgcttcagcttgagacgcatctgaaatagatgtaccgacaccttttaaatacttctcagggtcaattgtctttccgttttcctcaatttgaagatgaaggtgatttccagttgaattacccgtactgccaactttaccgatggtctggccagctttaacagtttgaccggctttaacagaaggggtatcaagcatatgcatatacttagcaacttttccatcatcctgctgaatgacaacccagttaccggcagttttactataaccagcaatttggactttaccactttgcaaagacttaattgcagtaccggcttttgcggcaaagtctgtccctttatgtggagttgatcggtaagcgccatcttgagcaccatacttagaacttattctaaacgcgctgttcttcgtgtagtagcttgcaatggaggaattggcagaagtcattgacttcgtgtaatttgacatgatcttctgaacataattctgtgtttctttgaagggagggacgccgccatatttaattacattaccaggccctgcgttataagcagcaagtgctttctcaacattgccaccaaatttgcttagttgttgggctagatatttcgtgccacccataatgctctgataaggatcataaacattgtttacgcctaagcttttagcagtggaaggcatcaactgcatcaaaccagcagctccggctccagagcgagctcttgcattgaatcctgattcttgttggattacagctgcaattagagctggatcaacaccgtatttgcttgcggcagaattaatgtagctggagtatttaccggagtaagacccaccaccagaagaaaaagaaccaccagaagatgaaccagaggaaagggaagaggtaactataccgtattgtgcaatgttccctgacttaatttgatccttgaggagtttggcttgctcctgcataagctttttcttttgttgaagagctttaatttctttctgcagggcatttcgataactttgggaatactttggatagtcgtttacttgcttattgtacttttcgatttcagcattaactttctccagagcttccttgtatttatcagccacgtacatggacgttttggtttcttcatttgctttctcttgctcgtctgtccatttttcaagggaagtacctgattctattaacgcttgtttgtttgtttcctgagtagatgtagcttcttcagatgctgagatgtaggatttaagagcagctctaacgctatccattgcagagatttggctgttagaaaatccaccaggttgcaacattttttcttcaatcttatgtaattctttcttcgcatcagctacattattgattgatttaacttcgagctgagacaattctgcctcggatatatcgagcttacgctctctccgaagctttctaaggctgtcaattcgtaaagaatcagcgtttaaggttttaatggcattattgacttcagttttcattagcttattgctatattgaaccatgtcattataggcatcgagcttaacttttcgctgacgaattacttcatctcggttaacctttataacaccattttcataacttattgctttggctaattctttatctttttggattagagcattagcttcattggcagaaatgctctttccttcagccatcttttctaaaagttcgtttaaaggagcaacttgttctttggtgttattaaaaatatccccgttaagaatgccttgaacagagtcaaactgcattgactctgacatgcctttgattacatctttaatctgactgatatcatttgcgtcaagcgcttctttgagcttttgaccaaaatcttcagcttcattacctgcttcagcaagagtttcccctaaatcaccaacttccgatttaacagaagaaatggccttatctccatctttaatgttcttttgtgccttatcaaaactcaacttaaagacatcaatagaagaactggattttgaataggtctccaaaagggtttgcagatcctttttcgcgctatcaaatgctttttcatcgtttgaattcaatgccgattgcattttctcttggagtttacccaatgcagaagagaatttatcgagatcatcaggattcaaatcatcttttaaagtgagtttacctacaatgtcattgatactcgtttttaaagtattgctgatatctatagaactgtatgcttgggcgattgagagaacactgtctctaacctttgcatttccacttgctatgtcagattgtgctttaagcataccttgcttcgctttatctgcagcgattttataatcttcatcatcagcaaggaagtcccattttggtctgcctttatcattataatcagcaatttgtttgtattgcttcaactcatctttagactttttaatttctttagaagcgtcctcgaaagttttcttggcgctgtctttagtttccgtctttttaagttcaaggtattctttagtgttctcaatagcttcttctaaagctttattactttttaaaattgcatttccttgagagtcataaccttgaattaaagcggggaatgtctgagccaattgctgagtaacttgaagatattcttgctcttcatctgatgaaagggttcttgaatctttggctttttgaagctctttatactgttttattagtttgtctgtggagtctttgttggttgtaattgcttcaacattggtctgttgactctgttcaaaatcatctttagctttttttgcatctgcgaaagatgaaactatgctttctaaagcccaacccaacgcagcaagcgcgcctccaaccactgtagaaactaaaagccctctaagagcagttttcaaaacccttgatgcaacagcagcacgggtcatacctgcttctaatccgatgctagctaaggtttcttgtctcattgcttttgagcctaatataagagttgtagctaaagttcgagtgtttttactgagtaacaatgtagcagtgctaatcgtcacaaaaagaggggggaggaaaccaacagtgttaattattccagtggaggcttttaacaaagaacccagagcttgagtgaactcaatcaatccgtcactaataaaggcatccgatgaagctatagccaattcagtgaaattgttttgaagtttatttaaccttgcttgtaagctatctgcgtatttctgctgttcgctccaagcgctacctgcagaattagaagctgttgcggcggcattttgggcgatagagaagttgttcattaaggcattaaatcgagacaattgatggatatttgcaacgccaatagaggtgttttgtctttgagcatcagttaatgtgttccatttggctgctacctcattaatcaactcactcgcagattttgcttctccgcctgcagtctttacagaaattccgatttcatccaacgctttgattgcgcttcggttgttacctatccgggcaaaaatagttttaagtgagttaccaacaacgtttcctgattcacgagtggtacttgcgattgctgtagtataaccaatcagatcgtttaattcaacaccgaaagtcgaagcggtgcttcctgcttttcgaatagagttggccagatcaagagtagttacagcgtagttgttatccacttcatttagcttgtctgcaattgaaatagaatcattggctgcaatattgaagtttaacattgcggcagttaaagtattaactgtgtcatcaggagttaagtcagagacgttttgtagaacctgcgcggtttttgttagagttgacaattcactttcatcgaagcccatacgcccgaaatcaccggtcatttggagaatgtcagtgattttgtttgaaagtgtgtcacctaaatcgattgactcttgaagaagttcattgtacttgtaatcaggctcattcatcacacgtctgatgtttgtcattagagtatcaatttcaacagcctgagataccatttccttgagtccagatatagcgccgtagaacaaagaaccagagattaaatatgtagacatacttttgaaagcttgcgttagctccgcaccaaaagacgaggcttgactagctgctgcttgcgcatttgaagccaattccctgtattgcatgttcaagctttgcatttgagctctgatattgcttccgccggcacttacattaaggctattaactgcattgaggtactcttggatagcttgtctatttccagcgcccatcgtatcgccataacgcgtattaaggttttgtacgtttacctgtgcttggcgttgataaagctcaatagtttttcggagttcattatttttagccacagcagcagacttatcatcgagcattttaattctgttttgtaatgcttcaatttgttgagctgtttgagcagtgtttaatttccgcccaagggaagagagggtggtgtcagttacaattccttgctgtctaagtttttctaaatctatctttagttgttcaattgcttttcgttgctgatcgtaatttgttgtaacttttgatgacgtagcatttgtctttggatcagtcgtatatgttatatcatcgaagccattgcggttcttttgagttaccctcgtcgtttgtccttgagaattcttctgttctgttcttttctgtacctgacctagtttttcagtcgcttgagcaagcctgttaacttcttgggtttgttcacgtagtgattgattacgattgtcgatgaatttcttttcacgctgaatgatttcgccatttttcttatattgctgcgtcagcttttcaacagtgccatcggcatttctggtaaccgttgtggtttctttaattgtttgattgaaggatttgagatgtttttggtaagtgtcaactgcagaggagaattcgttgagagtctttaaagcagaggcatcaatattggtctttaaattaagggaattaagctttttctctaaagatttaatttgctgatttaactgttcgacagtctttgaggaggtatcagcttttggggtcagtattatttttaaatcttgactcaaaaataagtcacatcctttcaagtggggctaatcagagcaaataaaaaagccactcaaattattgagcgactgtacttgttttcttgataattacatccatgacaccttgccaatactcagcgttttttaaagcttgctgtatgatattcccatcttttttataaccttgaggctcatatccatcatcctcgcgagaagggaggaagtggatatagtgtataggatttttgaggttttcgactgtaattttaagcgtaattgacttcaccatttctgtttgagtagaggaggctgacaaaccaccaattgttgcaccaattccgccgcctaataatcctccagcaataatccccgatttggcaaccttcgaaatcacctggtcatccagtgagatttcagattgaataatttgggcaaaagggacaacatactcgtttatttcttctccatttagctgatataccttaaggatagatttatcttcattgtaagcaattttagttttataagtgctaaagaaattatcagggttaaattcgctatcataggtctttagtgtttcagcattttttctaatcttttcagcaacagttgcattttttattctgtaaggttcgagcgctaaataagccaaaccgccaattatcagaaaaacccccaaaggtctccagccatccattaaacagaagaaaaggctgaataaaaaatagccaccataagccataatcttatagcccatccaaccaccaccagtattattttcctacattatatcatgatttccaaaagtgtagaactagcaaaggggagggtcactttcctttttcggacttaatctgctcaagtaattctttaaaatatgtagcagtaataacaatgtccctatcctttcgtacaacaaaaagtaggagaaggcaaatcgatgttgcgattagaatataccaaagcaaattaaaactaaacataattctgagagatagtaaacatgttcctatgagcacacttccaactgtccacattttcgtatgatcgaaggacgcttcaattcgactcatacgggaaatagctaaaattaaatctgatgaattgagcgattttaggatttgaaatttgcgcttttgttctgtgtagagctcaccagagtgcgggaattctttttgtatgtatttgatcaggtcgcgactattcatctgtactaaattgtgtttaagtattgtcttattcatatttttcacctctccatattatcgtcaaatatggaaataagtttaaggttttatccataagcaaaacccttcggtagaaggatcttgattctgcataaaagagggatttcatttacacttcaaattttgctttcttgtcttgaatagcatctttgtttacttctagatagtgattctttgttacgtcagtgcctttatggttcaataattgagacacgtcctctagactcatgccactgtgatacagaaggttactaccactgtgccttaaatcatgacagtgtaattcaggaatatcaattatttctccgattctctttatccaatatccttgtaaagttccggtttcagctttcttccatatgcctccgtactttgttatgaaaaggtattcgcattcaattccgttttcggatctgtactccagccattccttaacaagatcaatagctctttgagaagggaagagggtgactttatatccttctttttcaatgacatcttccacccgaagtctttcaaagtcaatttgttcaaccttaacgttgcttatggcattagctctggccatcgttgagagaccgaattcaaagaagagctctaactgaatattttccttctttttaagtccttttctgatttcttcgacttgttcttttgttaggaaggtctgtttaatttgaagtttttcaccagttccagctttaggcctgtctaagaagtcaacgggattctctttaatcttacgttttttccttaaaaataaaaagaatgagctaatactactcattcgtctctgaattcttcgttcattattgcctagaatactggtgcaaaatgcaacaaagtcttcaattaaatcaaccatatcatcaggatcttctttaataatatccacaatgtgctgattattgtaattctctaaaatgtataccagccattgattgaaatctgattgatatcccactttactggattccgaaaggttcatgtttttaaagacaaaatactttcggattaattccgcatttttggggttaattttgttgaccttttcttttgttgcatatgctatcttttttctggccattaatacaccaccgttattctgttttaataccacttgtatttaaatcttttatcatagcagcaactaatcgtccatcttttaaggattcagcagtattcttcatgactgggcgaggttttccgtaaccatagccgtatttatctggatacgtgtacccttgaccagtctcaacaaccgtagcaacatccttgccgttgtcttcacggttgttgtctaatgaaattccgttatattcgttttgaatgacaaaggagtccttcaaaagagaagtacgttcatatacaagaggatcgtatgtgtcatatacatcagattgtacatgctcttgacccgttttaatcatcgtattttttgtgctggattgtttttgaacggcttgctttgcggcaaattcaattaatgctgctatttcttttatgttcttggccattattcagcctcttgttcattctcaatctcttcgaccttattaaggatgagatcatttatttcttcaggagatatgtttgaaagtttgtctaaattctcttgcatcatctttgttgcttctccaaatttcttcatgctttcttcagggaagctactaataatcaatgggaaaaattcagagtccacaagcttaacaaaccacttaactttgtttttgatatcacttggaatacccaagtctgtaaattctttaattagtgaaaagaatccccattgaacaggatttatgcttttaaagtcaatgtttttttcttgagcattttgtgggtcagtaattaattcagtaagcattttggttaagcgggtaggggagaagtaagggtaaataaaaacatgaacgtcctcagtaagttgtactcgttctttcttgtcatatttacttacactttcttcaatcaacccaagatttaattttttcgatgccatctcatttcctccttatatatcctctgcacacattaaaaaagacacctcaataggggagaggtgtctaaataaaacttgtattttattctgtgtctgcttcttcgtagtcttcgccggtgatttctttgtactcttctaaagtgactaaaccattctttactcctaattggagctcttcttttgtcacatcgttgaattcctggtaagcttctttgacttgatcgacggttgcccattttcgactcagggcattaacccaataattgtatgtagttattttatgaacctccctttagatcagcaatatcttttaacattgtgtttattgttttgttgacttgaagcaagcttaggcggagttgggatagggtctgtcctattatttcaaaatcgttaggttcagggatacttggtttaacgctatccttgtattcttcagttgctgattcaatccatttatttttcttgggatcatatttgggcaagattattgtggggtctgggacagcagttgtactatttggaggaagagcatcgccttcaatgaagtcttctccagcgtacataaagttctcatcataataaagaacatgcataatattttcacctactaccataaaggaattcctatattaaatgaaactctggaaacactgttaatgtcattagcatacaatccatcaaaacgtaaatctccatctgttgtgaaggcaaatctcgctgttccatatgatccaattgtgggtactacaaaatccactagctgtgttggcttggttgagaatttagcaactgcagttccaatggccggcaatgttccgaaagatcctcttagccataacacattgtttacacttgagaatttgaaagggtaagtggagtattgtgtagctccattgataagtgtaactgggttccaagaacctgacgtgccactccatctggctttgtcatctaaagtaacgtgaatatcagtttttgcttcgtgggcatcggtgtaagctttcgccgagctgagtgcggtagtagctcttgcttgtgctccgtcagtcgtctcatgtgtttgccaggaagtccatgttgaatcgctctttctaaaacggaaataagtatgtgttccgtaatatgcttctaatgcgaattgtgcaatcgtagttccatagttcatgacagctaaatagacattggataagttggcaggggagtgaagcccctgatttgcgattaaataaaacccagtgttaatcaaatcattgtactccgttttttcggagctacctttgtagaatactttcccatcatcgtcagtgagtttgaaaagttgagcagcgtcccatttttctcgatcagacttgctgatatgaacattagtgtcattcagatgattatcaaagtcacttttagtagcttgttttacattgtctacattcccaagcccaacctgttcagcagtaaccttgtgtgggtttgattgatcgttagtatgttcagctaaaaaagactttgacctttcatcggagctgttccaataactgcgctcgtcctttgtgatatgtcgatccaggtctgcatcatgagcgtcaaaatcaattttcgctgcttgctgtacattatcaaccttagataagccaacttggcttttagtaactgaatggggatttttcttgtcgtcaagatgtccatcaaaagccacctttgtggcttgctcttcattaagtacatttggtaatccgacttgctctttagttacatggtgcgggttttctatgttctgagtatgcgactttaattctgaattttgcttttccatgaactcatcgaccttatcggataaacgtttttcatgatcagacatgtgagattcagttctgaaaaattgatctttaaggttattgatttgtatattgttttgtttgagctgacctacaaatttactgctgctcattaactcaccgcaattcctttaaccgtaacatctccatttacggaaatgacctcaaccatgaatttgaaaagccccgcaatatcgaaatcccagttttcatttgtattcaatgtacccgtacctaattgaaaatcagttttgtttgttccagcaatttctgtcttttcgccattttcatctacagcaaagaattttatttctcttgaagttgaggaaccagagatcttaacagtaatatcccgataatgtgatactacaaattcttcaccttcagacggggcagttgttgcttcgtggaatgtaaaggttgctttatctggaatggtttttaaaatattttcatcggtttctgtcaacaactccacctcctaaatctgtttaaaaactgacttttatttaaaaaggagaggggaagaatcccctcaaattatttagcttcaaatactcttacgtctctgtcagtaccgtcattgatcacatagacataaagtgttttaccagcggcgacaggaactgaaaaaggtttgtcaccggctgttaatgggatacctgtatcagcagttacagttgagttcccaatgtaaatcgtgccttctgcaggtgggtaaatagtaagtgctgttctgtcagtgatacctgcggtaactttttgagctgttgaagtaacagtgaatttatccgttttaaaagaggagaaaccaggatctctttcattcaaggtcacggaaggggattgtacttggatgcctttgatagcatccaaaccagcttgaggaaagtcaacttgtagtggtttttcttgtgattttagatgaatatcggtgattggtttaccagttccatcgtctctagctgaagtgtaaatgtctccgtctttgtttaaaagtgccaagatatcaagctcctaacgttattttgtttcttgcgttgttccaatgtctacactgctattcgatgtcgcatcttcttgttcagttttaattccttttgtcccatcagggttacgcttaacacgggcaaaagtaccgatcttgccattatcatcagctaatgctcggtatccaatttcaggtgtgtaggcttgtccagcctctaaggacatgtctgcttcaccagagaaattaactttaggtaactggatataaaggtcactgtaaatttttgatgtctttggatcgtactcaagtgtgtggatttcgaagtaatagttctcggagaatttttcaccactaatttcaactgtttctgcatcaacttcaatttgatagtgagctgttacagcgttccctttagcagcaaacgtttcaggaacagtaattgttttgtctgaaacattaaattcttgttgatctccgtcttcatttgtaagtgagactttggataaaggagtatacgcgattttgattgtgccggtatcacttacagtaagactttcatcttcccatacagaaatcgtctcgttttcaatttttacaccttgctgcattgccataaaatcaagatcaaagaaagcattttttacgttgcctgaaacctctttgcttgagttgatgacatacaggtctctatttccccatccgccttttaaaaagtcttgttggacttgttgggagaactgagtcatttgtgttacagaagatgcaacaaccttgtggtcactaagtcttttggttagcaccttgccaacttcatggataactgtttgttttgccaagtgttttcctcctaatttaaaatgaaaaagagactgtgaatcagtctccgaataattgctctaaatttttagcatctgctgtactgaggtggtgtttttcttctctatacatatcaacatgactattccagtcaccgattttcacatcagttgatacagtggcaaataacgcagaagtgttataattcattatttcacccattctgtaatatgacaggtacaattgataaattgtcatatcggctacctcttgatatgtgtatccattaaatgcagccacacagctagcgatgtcctttaaatcattttgagaattttggagttttaattgattattcaaatcatgaaactcctgtaattcatcattctcaacaattttctcttcagtcaggcaatgcatctctaatatcaattttctaacattgttaaatgctctctgatcaataagatgtagtgattccttgtccacaaatactttgctaaacactttaaaataagcctggttaaattcgggtaagtaatcatgaacaattttgaagagactattcttcttcaattcgataattaaatcatttaatgaaccgtcattgttgatttttgaaaagtttctgatgatttccttcttgctcattttcatcatatttagctcgcttatgtactctgggtaatctcttaagtggataaagtttattgcaccgacttcagtattaataggccttcctaaaaagaaaaaatcctttaacacattcatttacttgctccgaaagtgaatatcaatttgtatcccaagtacccttcaggcgcatttgatatgagcaaccttgtatatttaacatttttaccgatgccagcaaaattttgattgaagagcatgtcacaaatacgatcagtaattttcaggttcctgaattcggtctcctcataagtgttaatgtgtgtataaacatcaatcatcaagtcttgatctagcagcatcacactttgggttgagggtttagggattccattgccgagataaacacaaagtctgcatattggttgatcggttaaatcatcagttttgggagcacgtttaattattgagcttaatattgatggggaatcatcaactggatcataataattttccaacgtctgaacatcagggagagaagaggagagagggtcatctttataatataaaagacgattcaattctgtatcattcataatagttctaaatacagttgtcatatgttcaaccatcatactcaatcgctatcacctccaactttctttttggctataagtctaattgttccggtgtctccatagaccttggaatagtctatatcatcaacacggaattcctcaccataaaaagaaagaaaaagacccttctttaatttttcatgttttaaaaaagggatggtgacatgtgcttgcccttcaggaatgtttatagccaattctgatccaattgttgaggttgttcgttctaatacacacgggatgtcaaccttctcaccaggcactttaatctttatcggtctccctgtaacttcatcaatctttccagaatcaataagtttgtcagaagatgttagactgattgatgaattgcaaagccgcatagtagcactgtcattcattttgttatcagtggggcgcgcattaactaaccagtaactaccgtcatacaaaatcaagtctccacgatttaataagcctaaaactgtaaggactttttttgtttcgctgtcctgagtggtttgaattatcacctgttctggcttaccattcaattcaatgtcgtaagtttcaggtgaatttgctaagatttctttgaaaatttcatacttgtttgaattaaactcttcgttttcccagccactcaaataatttgaagaagaggttagataccaatctatagacatctaatcacctcaatcaaagttattcactttcagtttgctcatttttttttcaatctcatcgacaagatcttcataggatctattaacctgagctttagtattagataaacctgtcaattgaacatctcttcctacaacgttgtttaattttaaggctctgtctcgatatctgaaagagaatcctttgtacataagcattcctaaaacttgaatttgtgatgaagtaaggggatatttaaatgtattggacttttcatcataaccaagttctgtcagttcggtttcgtattcaccaactgcgttaatgaaaaactgctgttcaaggccatcagggagaatttcatttgattgaaacattgagtggaaaacgttaattattttttcataaggagtcaagatttaacctcccttatgattgagtatcaaatttaaacccagtgtattcttcaatgaacttgatcttagcgtaatcattaatcttttcttttttagctacatcaaacagctgagctttttcagactcaagtaagatttccttttgaacattttcttcgaaggctttttgggttttgtatcccaagatttgtttaattcgttctacagtaacaatttcttgtttgtcgtctttatcttcggtctcaaaacctaagtgcacacgggtttctttgtcatcaatatagattttggcatgagtaccttgaccgtcagttccagtaaatagtgaggtattgtcatagacttgggattgcacttccccagctgtgatctgtctaattccattggccggcaatctgaagtcaccgtgagagtcaatctttcggaaatataaatcccatggacataaatttttaattgtaatctttttatctaaattaaaagacatgtaatccctccaaaaataaaaggagggacacagccctcctaaattttaaattgtttaaatttgtggtaattcatattttgtgtctctgatgagaccaatttgatgttcttgtcctttggctacaccagctccaatttccatatcaaaacgagtgatctcagttccagtgataatgtcgttaccattcatcgatgtgagtccgcctttttggaaaacttgaagaggagactttttaccttgaggaatgaagaagagaagtccttcaggaagatatgttttgaagttatcgccggctttatttaattcagttagattataagcattaggtaattctacaacagaagaacctttataagtgttaagtaatcctgttcttcggatttcatccataacagactgagggagtttagtgcttgaagcatctccggttacagcctggaaccctgcaaagtcatttaactgagaaacaacagaaaagtcaccaacaatagaaggttgtccaaatcggcgaatctttgtgataatatcgtctacagatgatttggtgataccttcagtttcagcaaagtatttaacacctgttgcatttttaattgcattgaacatttcatttactacatagtacatcgctttgttcatcatatctgtttgaacttgctccatgccttctgctactttatcgaggtttccactttgaatctcacgatagttaacagcatagccagaagaaatggtttgagttccaatcgggtattcgctccaagttgtagtagcgaacggtacgtcaccacgggaagcttggaattggcttcggatggattcatgcgcgtatgatgtcatcattggttgctgatcatagccgatagttctaaatgtgcccataaaatcaaatagcttaattgctgaaataagcttaggctcaatggcataacgcacaattgtgttgatctcggctttagctacagggttgcccataagagctttggaagctagttccttcacatgggtcatagcagcattggcttttgctccaaacttggaaagatcttgacctgttgcagctgcagaaaagatttctacaataggggacttagcattcaatttagcatttgcataatggtttgagtctttttgaacattgtttaattcaactgtaaacattaataattacctccagaatataattaagcctgtactgttaggtacaaaccttttccgccaaatgtatttttctctaagacttttagagatactttaaactctgcaacgtcatctccagctttaacccatttacctgatttgtctgcagcaggaaccaatacgtcatctttaacaagcgcatcataatcaactactacgtctgagctaagttcaattggcagtccttttaagtcagctaaattaaaagcaaggacatattcaccttttagaactttgaagtcttctttattgcgaatttcaggtttatcaataatgtttccaacaacatacacatcaccttttgcagttgaagatgcacctggagggaatgcgttaccagaagaatcgttagggattacgactagaccagggactaaatcgacactagccttgcaacgtggattatttcgtacttgtttataagcaccaattgttccgaatttgaacattgagtattcctcctaaattttataaaagtgttattttatcttaataaagatcatcaatagtcactgaactttgttgcccagaatcacgaacttctgaataaatatcgaaatttgtgctattagtctcagaggcttgcttctttgagcgttcagtgatgaaggatcgagcgattgctgagttgatttcagaaataatttcgtttttaagctcgacagaaggagacttagagaacatttcaattttctcttttgcgacatccttttcttcaggagaatattcctttaaagcttggttaagctctccttgcatcttttcggctaccgccttgtttttgaattcctttagggaattaagctcttcatctgccttggctttttcatccttagctttttgcgcttctttttcttttgcatcagccttagctttttcatcctttgcagctttaacagcggcattcagttcttcagttttttgctttaagtcctcagtaagtttctcaactttttgatttaattctccaatttctttattcttattatcaagtttgttgtttaactcaaggactacttcttcttgagattttggcattaaattatcctccttttttttactgtttaattcaagcaaaatggcagcgtcgtctgcagggtcaatacctaaaatggcatcacctgtaaagtcaaatttcataggtatacgtccttgctctttccagccaccttcatattcaattgcatctgaatcttctacagctgctatctcaaccgaggtctcagggaaatcgccatcaaacatttttgattttaaccattgaacaaatttaggatagcgctggttgtataggaagccttcagctattaacactctttttggctcaccattaacatcaatagtgtcaatgtaagcattggtagtcgtaccaaccactgcgctgttttcaaagagaggggtgccgtccttgacttctgttaaaccgtgtccgaatggctcactgttttcatcatccaagaattctgcgcaaattggcattaacttgattgattcaaggttagcgtttatgtatttctccagccaggtaataccgttcttgttgaactgagtattgttttcatggatttcgagaacgacccacttgatgtatgtttgaccactggtttttttctgattgttaatttctaaaatcgtgcttttcaaatactaatcacctcctctcaagagccagaaggcgttccgttactgttatttgtcttcgatttaatcgtgttttcatttttcggatcatcgatctcaggtgcgccggctgacttatcgttattcttactcattgtgaaagaggtcgcatgaacagggaacttttcatcaaaaccttcgtctttttcatattccattagggataagtaagcatcaggattccatccagtagcggctatccaagcaataaggcttcctcgaccacttgtataaaggtctttcatgttttggactttttctttcctgttaacgtgggtaagagggaggtagtaaacctcaatataagagcgaggatctttgatgatattggcgtttatcaccttgttaaactcactttgaatttgttctaaccaggagaatatttgggaagaaaccatctcgatattggtttgttgagaagaatagttaccgtcttgaccattgagagcagatcctgcaaatcctaaatttgtagtgattcgtttaatgagctcgtcttcacctttaaccttcaagaaatctacattagtttccaacttgtctaattttgttccagaggccaaagagaagaacttaacacctttaacgcttcctttagcaactaacgctttttttatattctcatgctgctgctcctgttgcttttgagataaggctgatttgcctttttgatcaccttcagggaaagtctgataaattaaagtgctgttgagctcatctaaaatgtttcgtttagtgtcaacaaagtattcatcataaaccatatcaataaatgcggataaaccgattgggcgtccccattgatcttcaatgtcgctacttcctttaacagcaatagtcttattgttatcaagaactaaccattttcgattttggtctttcttataacccctatagccttgtctgatttcttctggccatcgtctaagcttgagcgatctcccgttacttgtgaacttatcaaaataggagacatcaaaagctaactgataagaggaatttttccttccgataattttgcaataatcgagaggaagagggaggacggaacaattaaagtcgtcaatagcatttgattcagttattgatccgatctcattgtcacttagagtggtggggaaagaatcatccactacagaatcaaaataataaaagccagtgccatatttgctgagttttcctaatgcatccctgacagcacttttgtcgccgatttttcttaaagccagattgaacttttgtttgttcgatttgaaattagctactttacttgatcccaaaataactctgtctaaagtagggagggctaccatgtagtcaataacgtttctatacacaccatttgcgttataaagcaatttagaggcatccctaatctgtttattgtagacgttgtggtctttcagccatgatttaactttgtcgtaagaaataccgttaaataaatcattaaagaacaatgaatcaagcggcgctaaatttgtattaaactcatatgatgactgtggttcagatgtagtcattattcacctcctcaatttctaattaaaaaagaatccaaatgaatactcatcatcggattcttccttttctaaaaataaagctatgtaatacagcgcataagcaattgcactgtacctatccttatcaattctttttacaacttgctcaacagtgaaagaattctgtgtctttttaattctgaggtttgctacttcgtcaataaacaattgagtttgaatacatgctgcttcaatcattacatcatcagatatgcttttttggttcttgatgtcatcataggatttaagcaacttcaattttccggactcaacataatccaggaattgagtaataatgtcttggttaataccttgggattttaggttgtaaacgatttccggcgaatttgggacatctggcttttgatcagtgtttattgtggcccagcatccaagttcttcattggtctccggatccgtaacatcctctaataaccggtcgattaaaccgccaccgactccgtttccatcgacaataacagctttaactcttgagagagaagtatcttgatttcctccatagtttttgaaaactctttttaccatgattgattgttctttaaaactcaatccgtttggtggctctataatattgaccacttgaacttgcctaatgaggttattgctgtttctgattatcttcaaaacaacgatagctgttttattgtttgattcagccgcagagcgggctacgtctaccccgattacatattcatgtagcaagaagttcttatttttatctctaggacaagaaagttcagggtgggtaattgtccgagctttgatcaatttactgatattaatcaatgcgccgtcacttgcaccaatccagtcacaaaggtaattctgacggaagcgagttacattcccttgtcgcgctttattaataacagacattttttgacgaccaaagtgaataggaatgcgccaatctgatccgaatacaaaggatcctttaagatcaccagtttccttaaccatcgtaaggattttttcgtactcatctgagtttttatatcctgatgtggagaaccggttaatctgcccatttaattcagcaggatctatttcgccagtcatggttgtacgagggatgttaaaaatcggctcgatagcatcatcgtataaatctttatcaatcaaggcagattcctctaaggagccacgtcttctacgtaaacccttagatgattgggcgtttgccaggttatcgatgatcgccccgttttgaaattcaactcgaccactgtcttttgaaaagttttcactcttgatttcatctttaatggaagggtaaaaccttaaaatttcctcgtgcttttctttccaaattttcaccgctgattcctttgtagaagcggtaatggctaacgttacattaggaaagcaaatagctgtatggtatgcaaccatgatctgggtcaatgtattatgactaactaatccattacttacaaatgagttggttaaaggcatatatagatcataaacgtagttctcagagtcttctgtttcaattactttagtgtaatagtaattagaatcataaagctctactaaatggttgaattcatcgctatctttattatcaaaacgctcattttcacttaataatagtgataatttttcgtaagtaagatcattagatcctttaagaacatgataaaatttatctcttgttttacctttaggataaattgctataatgttatcttgctgataagggatgacatctttatttggattgcgatttttgttacatattgatataagtttttcttgctttcttgaacaactaaatccaatttcccgtaaaaaaagatcaatattctttgtagaaatattgatcttataatgataagtattaaattttttatttagatatttttttctgaaagaaataataccaaagtttaaaagtaacatttgaacttgtttactcattttttctgatgcagtgcaaaattgtacgcttttatttgtcacacatccatcggtatcaaatagaccttgtattgtttttgcaacaatatttttaggtgctttaagtataattttaggtatttccttaccaaaagcatctttttcttccagtcctaactgtctgaagaattctcgaatgagcttaccaaatacgataaaattaattctatctttttgcttaactgcaatacctaatacgttgttaaaataatctatataattatttaatatatcttcgtcttcatttgtaaaaagtattgaattgtttctagtcaagcaaccatcaccaagaagataaccaataattaatgctaattgttcatcaatgtattctggaatattgaatttgtttctttctacttgccatctgccttgattgctaaatccatttaagaaatcatcaaagcttacatttagctttgtttcacttccaaatacattattgtttcttgaaataggtaataaatctccaactttaatttcactagaatttttgtatcttagttttccatcttcacacattactaatactgggtgatttaaacttgcttccaagtcatagccatcttgagttttgattttcttcgttttcttgaatccgcttgatatgccggccatagaagtttccattagaccatatctgtttttcattgagattttatgtattgtttcaacttcagactcttttttttcgtaattgaatagttcgccaatttctactaatccattttcagtaaataaaactgtgtctcctgcaacacattttgatccgccacgtggaatacagaagtagttctgagggaagcgactgagtgttctcatcataactctttggtataaatccagctcaattccgccgacttcgggtttcaacatatcgtaaaaaatgtctggataaaaacgaataaatgaggtgaactcagcccatttggagatattcttgccaatgaagtttgaattgtcatctggattcagaggggtttcaaaagctgcgtcgtaaatatctgttctgttttttgtgtgcttcttgtttttcgaggtgaagtttttataactagccattaatcttcatcacctgtgtcataaagaggttctttgtacacattctccaagtctctgaaaacattgttgcgagcactctttagtttatcaatttcttcaggcgacaatccttttgatttgaagtcttcttcaagcatttcatcataaaaatggtaaatgtctttgtaatcgactttttccttatcttcgagccttctgtaataatttataatcgcccaaatgattagatcagcgtcatcatatggttgggctgctaaacgaggaagaagggggataatgcccaattctgtttcaacggcttcaaataattgagaaagtacatcgactccaccactgatatcgctcttacttaactgagatacattaatttttgcatctgtagctgcctttgaagctaatgaaccccattctttagcttcttttacatcacctttagcagttgctaattcctcttttacacggaaacgaatatatgaaagcaagccttcagtatgaagtgtggttttttctccgtaatttcgaataagtttattgtattttctttcaaactgacggtactcatcgggggtgtaaccaataccccatttatcaatcaggtcatctggaatttcagattggctaacaccagaattgtttgtaggcgtagattcctctataagtggcttctctggttgtctttcaaaaacactgtctttataaccagtaccgttaaactgcttcaatgaattagccattgtcatataagcactaaatgtatctgtttttctcttttcagcttgttcccaatacaacggatcaaatttaacatcgatctgctgtaagactgtatatattgactcaatattgctgtaatcaatgtttttcttcaagcaagtcttgcaaatagggacttttcctgttttctcatacagactacttcgtgaattatagaaccccgactctttgtccttttctttttgacaagcagcacagatcaatttttccttttctttagcttttcttggcattggttcacctccaaaattttggttcaaaaacacgttttataaaacgcccagcaatagagagggagtcgagatttctcaaatcatcactggacgttctaaaaaagtattttatttataagttaaggcaccgttttcggacaaaacaaccttggttccttttaaggtatcagcaagagcatccagcaaaccttttccaataccgtttgcatcaattattaacttactcggtcgtttgtctataataatggcttttatttgactagcctgatgtttaaacgttccatgctccactttcttagagatgtcctcaatacgggaattatttaaatcaataattaaaaaggttgtttcttctcttctaggattaattacagcaattctttcaggattgtagcccgtgctcaatgtgtagctagttccgtttaagggtttagtagagaatttgacgtctcggttcaattgttcacttttagtgtttttctcaaatcccaggcttttatgcagacttgtcagggcgtcttttaattccctgttacacagataaccactatcattaatttcttttagcagctttacatattcccaaagaattttagtttcttctttcaatcttcctcatcctcatctttataaaattaaagttttatattaattaacaatcaaatttactagagtgctcttactttcaggggacaggttgtcccactgcactgctaatatttctataaaatcgtttgcagacataggatcattccttttacttttcatttttaaagcgaattatgtatgtagcctcaatacctgcatcatcaaaaaccataaatttttgagaaggttttgtgccaaaccgaccttgcatagcataatcatccgcaccaacaagcgctccgtttactacaacggttgtgctgccgtactctttttcataattgtgatgaatatgaccaccgaatatgtaagaagggatgtagccaagtaattgaggtaatcgtgttacacactgatcaacacgatcgtagtgtccgtgcacaaacacgacttcctgattgttgattttagcggggatgaatccgtcttgctcaggttcaatggagatgttctctatgttctttaatctggcttcaagataccaattaatgaggtattcaaagttttctttaatccctacatcatttttagaaggggagaggcgaccgtgattacctgccacgttgtagaacttaacctcttgaaactcacttgccaacatcgctaaaacctcggcaagcgtttctgatacatatttaatttgttctacagcatcttcattggcctgaactcttgtagacacatgaataagacctccgattaaatcaccgagatttgctacatgcagtgtggaaacatgattctgcttaccatactcaatcactttgttggtgagatgttctacacgttcattaaagatttctttattgaatttatttatgcggttgtcgatttccattccgaagtgccaatcactgaatagagcgagtccatgtttttcagcaatagcaggtgatgggaaggtgaagcgaaggggtctttttgactctaaagatgcaatagcttgtacgacatcatctttaatttgttcaaaccgtgcttgattggcaatgaatttccgatattctcttttttgatctcgtgctttgattgtttgtttttcggattcaatgcgaatttcttcatgtttttgttgaacttctttgttcatattctttgagataaagtaatcgtgccagcgctcaaattgtttaaagtctttacgccatttgctttcatcatagttggttccctgatccttgtttaaaagggcagcaattgtttttgtgtcaatgtgataagtgtctttgtttttgaaaagtctgatatgataatcagtaaatgattcgtctttttctcgttgtaaaacagtatctaaaatagctgtcattcagtcaccacctactcattgatttgtggaagttcgtcttcttcggtaatagaaattttcactttccgaccgtcaaatgattttaaaatagaattcagatcataacgctcgatgtctgtttttgtttcttcttcaataatcccatcaatgtaagtatagttaccttttaaatttactgtatgaactttcttagccaaattaaattcctccaatatttgttttatttacgtacaataagctccttcggaagcccgatgatccgaaacatcggtaacgtccgaaaaggggatataaggagatgaaaatatgagtcggataggcgttggggaaacgcccgaaggagattattgaaaacttgcgtaccagaagtctcgtaaggacattccggctgatcagtaaagtaaaacgcaagcacaaaaagacctccgccgtagggtgcggaagcctcgttctgattgcgtctatacaccgagatcaggacgcatcccttactcgctcgcttctctgccggacaatgccggatgtatagttggcgctgttggcttttagcaagctgcgatagcttgacacgccgccttggctattcgtttattatgcggacgaggatttgcacctcgcatggacgaatttcaacaaccgttagccaaaccgactattaagtagcccgttgtctacctcacagcatcgtccttatgttcgtctaagcgtctacctattccgccaccgcatcgttaggttttaagacactcgattctaagattacctgcgcttgattatacgcttcctcataatcgccgctcttaaactcgtctaatttttcccggaattctctatgacgttttaagtaagcgtctttgtcgaatttaatacgtatcggcattttcgtcctcccttgaaaaatatacgaaattagcgtttttttacataatattcattaactcacgtaggtacgcaaaatcgacagggaatacgctgattacgggttcatcgttcgaaatctttgtaagtcgaaaataacaaaagacgccaaataacgtcttcagaaactccttgtacatcatggtacatgagcataaaaggctggttatcgctgtgcgaaatccagctggctccttctacacctggcagatgagctatgataacaaaaatacacgctttaagggacgtgttaaaattcctattacctttacatcttatatatcaagtttttatgttgcttgccaactgctcagtagagtctgagagccaagggaaaaataatttgagaaggaagaccctaataagccttctcaatggcattttaaatgctcttgtcgggttacacgccttattgagaaacaaagcgtctcaaacgctcgccatttattttgcacagttttctctgacccgtgtaaggaggtatgtgcatgggaaaggtaagtctccatacagaacattgaaggagatgaagtgaaataaagtgaacgtgttgctaagtgaaattgaaaaggcaagaccgaaaataatccttttctgtgaaatgggagcggtgatcaatcgcccaaaaaccatctcacttattttgcgaggggatgtaattacaaaaagcctcgctaacccggaaaaatttttatgtgaccgcataataagcatcaaagcttacaagggcattatttaaagggaagggagacgcatctaccttacctaagtgcaagccgaagcaatacaccgcaattaatattcaggctatatgccacccataataagaccctgatgggattcagtcgcaatttgcaataatgcgttaagtcttaccgacatttttagcccgataatagccatttacctgtctctttttagatacagacatgcgagttaacctcgaaccctcataagtgaccattatccgactaactacaatgaccagttgtagctgtaaagtcgaatttaatgcttttgttcgtatgaaagtgagaatagcaatgtttagaaaaagcttaatccacgatggggcaataccccgctaatatccacttatccaaaaccctggcatccaagacctcaaacaaatgaatattagcggagaactgatatcccacatatcagtaaacagcttattattgacgacacccccatgccatcaataaaagaactctaattaataaacctggagatgaatacatgaaaaaagaggggaggtcgacaatttcctccataacttctaactctgccacttttaggagcataagctctatgtgacaaaggcgtgcaggaagcctttcctgtcgtcctcagtaaattttattaagctttcactgcgtcttttagagctttagcagccttgaaggcaggtgcctttgtagctggaatatcaatttcctcacccgattgcggatttctccctttacgagctgcacgttcacgaacttcaaacgttccaactcctggaatcttgattgattcaccttttgttagtgcttcaatgatgacattaaatactgcttccactttaggtgcagcttctttcttagtaactcctaatttttctgcaacttctccaacaaattctgttttgttcatgttttaattcctcctagtgattttgtttatttttgtgttaaagtataattacggtatcgtttgtgcttcttttgaaaaaatgggagacgtactcacccttatatgtggaaattagctttctttctcccttatggcgattatctcaaaaagggctttcagaccagttatatcaagggttcaaggggattttttcgttaaactttttccggtaaaatcgctgtaccccttgggggagtaaggctcaatacactttctatttcgtcatttttttcttactgtattttttttgccttaatcgatggttctttttttcaatttccaatgcacatttattacaatattttgatttatttgagattgacttaaacatctttccacaactataacaagatttaaatctttttaaattattctgcatgttttccaatattagatcgccaaagcactcccataatgttgatttaaatttgcttttctttttatataaatgcttaaccaaaacatcagcaacagattgctcgtcattatagattttcagcaatctgtctttaatgaccttataaacataaagtttttgcccaggcttaatgtcttcatcattcatgagccatttcttgttctggtctaatcgtttatattcacgaataattgcatcgtccaatttaatatccctgttcttgagcaggaagcggtaatcaaattttcctgccactgctgcgaaattaattcggtcagaagggataatggagtctaacttatttactgtgctttcattaattaactcaacactatgttcttctttatcctttgcattgataaagaagtgaggcactttattttttatgtaatctttaattttttcatcaacatgatcaggacgggtcggcatgaataaggtttttgcaaaatcaatagtaaagttattttccatgcataaccatttgatcacatccagatttatattgtcgctgttccatatcttagtgatgttgttgctgtactccccgatattgatcccataagcaagagttagtgcttcatagatgttcctgctattaatcttttgtttctgggctacagacatttcataatacaacggaacgatgttttccatattacgcttggcaatattgacgattaactcatcagaaataattaaggccttatccccgtcattatcaaactgcagcaacttagatatcggatcatgaatgcttgtgtaaacacctggggtaatgaaccacttttcatatttctcatcttttttgttccacctaacaccatgctctctgaataggtgaggggagcggaggatgtcaatatacccttcatcatataaagaacaatggacatcatttcctgaaagcagtccttttggattctggatattcagaaataatttttcgcagaaagcatatagatcagggcataagtatgtataacgagcaccatcaacaagcaattttcctgatttggcatctttaatcatgcttttctttttatttttaataatttctttcgtgtgatcatcgttaagaagttctggatatagaagtaaagcgtcctgaagagctgtccgatgtttctttttctccgtagctccaagaactcttaacatggtttctttgtcagttcccaatgtggtaatctcttttacagtctttgagctcatttgaattaattcttcaccggagatatctgtaagtgtttggagcatttgataagtgagcttcccttcaacagaaggatcttcttcgttgagttttgcccctaagcatccatattttttataattgccttgatattcttcccacgatgaataatacttccacattttaaactggcttttagtgaagataatttgaacatcatctttcactacgtcccattccttgccgtatatatcagttactttaaaagctttgttttcctcagcaaatttgcgaaaatcaaacgggactaataaaccctttacccatgggagtctgaccatgaagcttttgctactcagagtggggagaatcattccgcagccatccgtatgctcaatgggaatgttcattgtttttcgtgtgatctcgtaggtatctcgatcaatatagtcaacgagactcgacacatcagtttctaagtcgtcgacaacaatggctttatcaatatcaatctcccaagggctactggcactgttagataaggccatatagctattccatttgttaatgctgctaccaccaagggagttaatcttttcaatactcaagccgcatgtcaaagcatcctgatacttatcgtaggtgctttttttaatgaaacatgacttctttgtacgaatttgaccggcactgctcgtgaaataaacgtatttttcattgttatgtaaaaatccctgatcaataatgtccttcaatacttcaaaatggtaagtctggacaaccatgatttcctctgaaagggtgttttctttaatccctaatgttcgggtcaacactgaatcaaataaagaaatcactttattgtcccttaagctgtcagttcgaagtgttcttatgtcattatgttcttcgaatgcagaatagaggcattctttaaggtatgtaattctttgtgaaatgtatttcttatgtttattatttacattgtctaatgtcttaagataatctctgtatctataagacttcaaaatcttattatgtaatgaattttctttgtcattataaaatgctgatgtgtccacgctgtatatgtgaacttgcttagacaatccgtctttttttcttttcaatcaatcctctccttactattttatttttactttaaatgtgcttaatattcgctattaagatattgatttactaaacttcgatatgtaaagctttgcttattaatctttccgtaccatttgtaatcctgataaaggtattcttcttcgggtgttgctgtaccatcgactacttttccctcaataaaccccattaaatgactaaataaatactgctttttcatcttacacctccatactattttatttttactcttaaaatgattaaaataaagaccacttcatgtggttgtgtctttattatatattttatttttactcttgtaaacataaaaatccaaagttaattggatttaatttcgattaattcaaaaagatcgtcaactttacaatttagaatatgtgccatcaataaaagattgtatgtactagggaggacggttgcaaatccctcgctgtcatttttacaccatctagatatacttgctctttcagcttttatttgctctgctaaccagcctttttcaatacctttgctgtttagaaatgaatccaacttacttttaaccctatattccatttaaatcatccttttgctgtttgaataaattttataaaatgactggtttacatacaagcagagtatgattatttgcattaagatacaaaaatatttgcatttaaatgcaaatagacaatataataatcgtatatcaaccaagatacttcagaatcatcagatattaaggaggggtcacatggatacttattttgcttctgtcattgacaacttaactcgaaatgatctgtatattctaggcttattgagcgatgaaggggctgatttaaagtttaaatcaattaggaagaaaaccattcaagctaaaactcaactaactgatgctacttttagaaagagcattgatcgtcttgaggccttgcagtttattattatagtgaaaaacagtaaagagcatacaatttttattactcaatatggtcaagaagctttgagatatcaattaaaaagggagagggtttaatgtttggatttattggagttggtcaggccggtggaagtatagcggatgaagcaatgaagagaggatttcattctgttgcaataaattattcactttcagaccttaattcattaatcaatattcaagataagcttcatctggtagggacagaaggagtaggtaaagacagaagcgtagcagcgaaacatatgaaaaataactgggagtcctctattgagttcataaagaacacaatggaaaagccttcagtacaagttattttcgtagttttctctgcagctggtggaaccggttcaggagtagcccctatattattagaattgttaaacgaatgtcttacacataaaacaatagttgctgtaccaatccttcctgacaataatgaggtattggttaaccagatgaatacactggagttacttgatgacttatctatgccagagacctgtgtcttacctttggataatcaaatggttttgagcaaatatgaagggaagatttctgaaagcagactatacaaggagacaaacaagatgttccttgatttaatcgaagtcttactcaattacacggacagaggatcaaagatcagtacattagacaggaaggatttaaatcagctttttgacacaccaggaatcatgactattgctcaaacagacctcaatgaatttacaattgagggtaagtattttgataagctgcatgaagatatacagaagtcgtggaacaattcgatatttactcctgttgagtttacaaatgtgatgagagctggtgtcattctggatgttcatgagtttttaacggagcatatatcgtataatgagctgtttaatgtctttgataacaagatgcccctagacttatttaaaggacattatgataaagggaatagggcaataaccatccttagtggattaacctggatcaatgagcggatgaagcagttagatgatctaattgaaagtggaaacactgaagttaaagaaacaactgtctataaagcgaagaatcgccgtagagaggatttattcaagccgaggaagctggagaacaaggaatcgaaaaagacctcgtatatggaggcactgaagagactaaaacgttaattttaaagggaagctgcctattatggtggcttttttattttgatttttaatgaccccccgggtgatcgttagctataaaagtgcttatcgtaaatgaagatcagaaagggttatttagttgatatagcaatgttttagggctgtcaaaggggataataggtgttttgtgatcgtaaaacgtagacaggagagaggaaaagtggttgtttatttaaaaatctgatgaaaaaggggagaataaggggtggaaaaacattgatattataggcttttacgatagcgattacgatgtgaaaataggctgaaaaatgggaaagtgaaaaaataagtttggtgtggaaatggaagtgctaggggtacatttgttcctattttttggcctttagatgttaatataccccctatatattggtatttaattccctatataagatacgttatgtagggtttttatgatttaggtgataaatttgcacagctaacacaatttcaaatgaaaaacaatatatatttttgaaaaaataattaagcggtcaacttaaaagtgaatacccattcattaaaataatcgtgtatataacgaaaggaaacaaatcgaagtgttatctatacaattcctcatctaactacacacctattttatattcatccttaatgttcatcttttcccatcctcattacattgcatccaccataaactatcctcagcttacctaatcatctctatccgtttccttcaccatacatcatatatccatcctatacacactaagcacacatcatcagaagcattctaatccacctagaatcaattttaatttaatcatagtatcattggtatccaatccacatacacgccttatacagcctataaatagccatgaataatagtgccaaaataatttaaaaaaatccattttaagagtaaaaataaaatgactttgaaagggaaatgtgctataatagagttataggaaaggaggtgtacatagtgcttgagaaagtgggtataacaattgctttccttattcctatcacggttttaatcatcaactgtttaacgatagctgagaagattcaaaacctgatgaagaataagaaaagcaaaaagcgtacacgcaagcgcctccgtagcaagagacaacgcaaacgtatacgcagataacacgctaaaggggaattaatcccctttagtcactacccatattataacatggacaagcacattgtaaacatgaaacgattctcattatggtttacgaacataacatttgttgttttattcttgttgtttctgttcatcaaagattatttcagcagcggaatacagtcgctgattacggctatcttcatagtaacgtgtatcattgtcattttgtcatggatcatttattttactttacgtaagaggttaaataaataaagtttgtggttttctggatattgatttacaaaaaaagatcaaaaagatattgatcatttaaagtgatcatgatataataaagttacaagttaagaggaaaaatacaatgtatataggaggataagaatatgattacagaagatagaatttttgaaatagaagaggaagagacaattgagggatataaagttagacgtgtgaacatgtcagaattagaaatcattgatagagaaaaaattgtatttaagggggaagaggcagaagtagctgaacaccttaactcactactcttttaaatatccattttaaaactctagccgatgcttattagaggtgagcgggataggaaacgaatccttgagggtatacagtatctttccgcgaatgtagaaagtgaccaccgatacaatgataagaaattctctggtcttgaaagacgtattcatgatcttgaagaaagaatcaacaattgaatttcatacatgagaaggagcggtaaaacatttatccgttcctttatttttaatattaaagggggaagtctacacttattatgaataaaattaaaataattgattcggttatggggagcggtaaaacatctgcagcgattaacaaaatgaattctgctggtaaagaagaaacctttatattcatcacaccttatttaaatgaagttgagcgcataaagaaaagcataaagtccaaacaatttttcgaacctaaagtaaagaagaaaggtgataaaacacaatataagtttgaatcctttcacgaactcttatcacaaaataaaaacattgtggcaactcataacctttttaaaaacgcaaacgacgagacaaaggaacttatacttgcaggcaattacacactgatattagatgaagtcatggaagtagtggaacaattacaggtaaagaaacatgatctaacaacactgtttgattccaatctgatttatattgaaaacggttttgtcaaatggaatgaagaaaaaaaagactatgaaacacgatacgatgacattcgagatatggcgttaaataacaatctaatgtatttcaaagacaatatattgatttggaactttccagccgatgtattccagttattcaaggaagtttacatacttacatatatgtttgatgctcaaatacaaaaatattactacgatctgaacaacattaagtatcaaaagtacagttcagcttacatggatggacagtatagcttcattgatcaccgtcctgattatgaaaggagctttaaaaaagagttaagaaacaaaataaaaatatatgaaggaaatctaaacacaataggacaactggagttttcactgtcttctaattggtataaaaataaatcaccttacaccatcaaaaaggtgaagaacaatgtattcaattactttaataatattgttaagtcgtcaagtgatgaagctatgtggacgacttattcagaccataagaacagaataaagggcaatgggtatacaaaggggtttgtctcatgtaatgcacgtgctacaaacgagtttaagcataagaaacacttagcatatacaataaacagatatacgaatactgttctgtataattattttaaagaaaagtacagtattacaatagaccaggacgcatttgcattgtctgagttagtgcaatgggtatggaggtcagctattagggatggagaagaaataactttgtacataccttctctaagaatgaggaagctgctcacaaactggctcgatacctgataaagaggacaaacctcttaaacttaaaaaataagccagtcatatcaacggttttagagcctaagtcttaaggagaaccagaaaaataattaaataaaaaataataaattcgtccgtaaagtgcctttacggccgtctcgtttcagcaagctgaacctcgataataggattttctttatttagaataaaaataaaatatctattgattattttaagtgatcatgttaaaattaaatcaagtcaaaggattacatacatttaagataaaaataaaatagttataaagaatggagaggttgaaaatgacagctgttttaagaattaatgaagagttaaatggaattgaactatattttgatagtaaaccagaacaagaggttttaactcatcttaaatcaaacggttttcgatactctggattcaaaaaatgttggtggagcaaacggacagaaaaatcaatgcaggtcgctaatggtgttactaaacaagaagtctcatcttctaaaacaatcacaaaaaccaaaaagaaagctaatggtgtaaatatgagtctgtgggatgcaacacaatggagtgaattagaagtaaataaggaacaagaagtaaaagaaatggcaaaggaaataagaaagcatttaagacaacgtctcccacaatgcaaattctctgttactactgggggtagctattcacatagcactattaacatcacaatcaaatcaagtccttatgaaaaaggctcagcttatttgactgcgatttatgattattgcaacagtcttttaaacaattatcgccattgctacagcccagcagatccttacactgactatgctggaagctacaatttctatggtcgtgtttcattagattgggaatacacagtgacagagcaaacagaagaaattaaagaagatatgacactgtttgattcaaagatggaagaattcgaagaagccgagaaagcgagaaaagaaaaagaatttcaggaatatttaaaagaacaagaaatcaaaaatgctgaatataagagacggcaagaagaaaagaaacaagccgaaaatatctatagcagcattgtagtaaaacaactgaatgaagatcaagagtattttgttattgatgcacagtttgccaacttaaacaaaaatcaagcacttgatcaatataaagacgaggttgctaaaggtgactacagacttgaaaatgtgaaaattacaaaagaagtgcatttcaatactgaagaagctttaaacaacttttctaacttgcttttaaatgattttgattttcttgcggaaaccggtggaagttttacggaagacaacaggatcaactcaatgattgattattacaatatggacgatttagaaaagaacacagttaaatggaatttatatggcgtaggagtgtactacggcgggaaattgcaatttattgtagacgctcaaggccattcttatgcaagatacgttggtttagtggacaatgcaaaaattgaaaagtcaatttttgataaacaagcgataaaagaaggagaattagacgagttaaaatatcaagcgggaaaaatagaagatctttctagctcagtcattgaagaattaaatatatttgcaacctggaataatgaagactgggacaaatataaagctttactcaaagaaaaattgaaattgaataatttaaatttgagtaaaaaaattatccaacaagcagatacagaggaattgaaaatttctttatacagaattctccatgaagttgacagcattcaagaacaatttaaaaatgctgatcttgaaaaaggtgaaaaatatactctgttttacatatctgatcttggatctttaattactgaaaaaataacgtatgacagttgccagtcaactaaatatgctcaatatgataatgcagtgaagttgacatacaagcctgaaaataaaagaaatttatattaccgacacttctattcagaattattgatgttcaaagggtggcactcgctgcccgaaactgtgttgaataatgtagaggttaaaccagatgggactaaaataattcacagtaagtactactcgtgtgacaaaagacaatttgacgaggttctaaattacttaaataataaaagcttcaaacctctaatcaacacatataaacctagtctataaaataagaggggatgagaaaacatctcattccctaaaaagggagaacaaaaaatgtttaaagataatccggatttttatccgacaccaccacagttaatccgaaaaatgacatcaaaaatagaatggaagcatattaagtctgttttagagccgtcagcaggtaaaggggatttggtagaagctattcacaatcaattcaaatacaccaagaactatagagggaattcgaaatatgatattgattcaattgaacaagatgaaaacttaaggcacatccttgaggggaaaagttatagagtgatagcagacgattttctgacgtttaacacttacaagaagtatgatttgatttttatgaatccaccttttagcagcggtgttaaacatttattaaaggcgattgaattaattgaaaagcaacaaagatccggccaaattgtttgcttactaaatgccgaaacattaaaaaatccgtattcaaatgacaggaaatttcttatacgtaagctagaggaaataaatgcagaagttgaatacattcaaaacgctttttcgaactcagagcgaaacacagaagttgaaacagcaataatttacataagcattgaaaaacaagaatatagcagcgttctaatagaagaattgaaaaaagatgagtcacatagaattaatgaggattataaagcaacacagttggtggactttataaaaggaattgtagaacaattcaactatgaaatcaaagcgggtttaaaattaatcaatgaatacaacagtttgaaacccttaatgctgcatagtttcaatgatgacagtactccaatattgaagctgctaattgataagaataccgaagaaaatgacatagagaatgcatatataaaacaaattagggcgaagtattggaatacgttatttaacaatgatcaatttatggggctcttcacaagcaatctgaaacaaaagtatttggagcacgttgaggaattaaaagattatgacttttctttgttcaatatctatacattgagaattcagatgagcaaagagatgacgcagggcgtggaagatacaatacttaacctttttgaagaatttagccacaagcattactatgatgaatcatcaaaaaatgtgcacttatataatgggtggaaaacaaataaatcatataaaattaataaaaaaataattattccactaaacgggtattgtagttggctcggtcactatagtccaacagactacaaggtcttagaaaagttgaaagatatcgaaaaagttttcaattaccttgacaacgggttaacagaagacataaacatagatgaatctctaaaactggctaagcattacggtgaaacgaaaaaaatagaattaaagtacttctatgtaactttctataaaaaagggacatgtcacattgagtttaaagacaaggaaatgcttaagaagttcaatatttttggcagccaaaagaaaaactggcttcctccttcgtatggcaaggtaaaatatcaggatatgacggcagaagaaaaagacgtaataaatgattttgagggggcacaatcttacagtgatacggtaaataacgcttcttattatatactggatacatcgaagcttctcttgcttacatcataacaaaatacacactttaagaataaaaataaaataagtattgattatttaaaatagtcatgatatacttaaatcaagttaaaacaacagcgaaagcatacatattttaagggtaaaaataaaataaaatgcatattttaaacagaatggagacattaagatgagtacatatcaagtagatttcaatcaattcagaggaagtatggaaacaacatgcgacctatataatttagataacaatacaacgcttcaaaccagcctttaccgtaatactaatagcctttgcattgaatataaggtaattcagcgtgatgataattcaaatagttttgcggagtacgatacacttgcccgtggttacattgaagtacctttgacttacaatcaatttaagaagcctgtaaaaaaagtttatctaaataaaataattaacgcactagattttattattaatcaatatcttattatagaagatacttctcaagaaattaacgaacgagttcaaatgaaagtgagtgcaactaaaataaatgaggaagatcaatctgactttacgaatgaaacctctaattcaccaattgatcaaattaggatggaaagatgggacagggaatatgacgagggagttaaatatttctttgataaatacgggaataaacgtataggggatattatttatattgatacacagcaagagcttgagcatttagaacacatagactgtgataatgtgataaggatttttgtagacaaagagcatgaaaataaaattaaagctattgtacttaaagatataaacaaacattatcaaagaagtggataaaacaacaattttatacaggagatgatgaagtaatggcagtaatgaaagaagtgtcaatagaagaatatgatttatttagaaaatggtatttaaagtataccaatagcagagtcctaaaaacaaaacagagggcagggtttacggctgttcttgacaagaaaacaaaagaaactgtttgtagcgaaagtcatcttatggggaaaagtagatacttaattaaacaaaattattatgatttatatgcagaggaggatgcggagtaatggctaaatgtaatgattgtggtaatgaacgttttttctacctagaggtatcggtgggagccaaacagcttattgatacaacaggtggagctaggaacggaaagatttatgatgtagactattcagattcaggtatagacaatatcttcaataaaggtagttatatttgtaaaaaatgcgaatcgaaagacgtacatcatgaggatggcgaaggtgattataaactctataataaatctgaataaaacagcagtttaataggaaaggggaattatatgcgtgaattagaattattgctcttagtgatgtgggcagaaaatggtgttaacgaagtttataagtataaaaatagaatcaaggcattccgtgatccgttggttaatatcgagttgattaatgacttgagttgcggaggtatgtttgctgacattgacgacgttgcaaaccacaagaatgcttcgtcagtagattataaagtaagtatcgcaaccttagttgaaaatagaagataataagataaatattttattaagaggaatgcctgtctaaataaaaacaccatttaattcgaaacgcttctttatcatcgcaaagaaaaaatgtaaaatccacctattggcatgagttgtcaatgatattgagacgtcattggggggagaaatttgaaaaataaacttgaaaaattgcttcttgaaaagggtgtatgtgaatttcatattaaggaaatgaaggacaccaaaaatataagtgagtatccatatgaattgtattatgatgaagtcggaaacagcgaaaaactatatcgggatgtcccgttaaaaaaaattaagagtttaggattcaggggaaccagtggtgtgtcttggtttgatcacgcgtgttataacggtacagataatattgacattggccgatgtgaaaaagcttttgaatacttaaaaaaacaaagtctagaagaatttcacacttattatcaacactcaccagtgaaattggttcattatgaagatgatgacttttatgctgtttacggtgatggaacacaccgtacaatttgggccaagataacagaagctccaacaatttatgctcaggtaactagagcaagaaagaatccttccttatataaatcatacttaagatttaaagaattagaatcacagattaataggtattttaaggagaatgaccttagctggggagttaaaaaaagccaatactattcagaaatcctttacaaaggtatgccagtagcactctattctatagatccgccttactcatttaaccgatcttcctacagtctcaatgatcaaaagttggatacatggaataaggaattaaatgaatttatgattgagtttgaagaaagttttcgctataggaaaatctttcgcaatgttatgaaggttacgcccggaaaattagagcacaaacttttttcttttattgaaaatttaagtgaaagttggtctacagctaatggaaaggcaagaattataaaacaaggattcgatatgtattgcatcgataaaaaaatcatttaagttactttaaaatatgtacaacagcatgagggatgacgaagaaactaaaggagaagtgatgaaaaagttaataattttatgtttgggtattatcggggtatttcttatagttcagtgtagtaaatttaacaacaatacaaaagtttatgtggatactcaattagaggtaaatcacgatgatgaaaatgaaagaaaaagttattatgacaatgattcaagccaagaaagtgaagcacttaatgacaaatatttaaacaaagaagagaataaggaatatgacatttacgcatatgatttaaaaactagggaaattcaatcacgtaatggacaacgtgaatatgtttatggaggcaacgtgatctctagcactcaagccgaaaaatatggttatcatacaacaccaattactaaggaaggagataaaacaatcaaattttggaggaacgatgtaaagtttgttcctgaaaagggtgagattgtcctggttagatttcctaagggtaatcataaaacatttgttgatattgagcttatgtataagccaacaggagagcctaatggagaatggaattggtgaacaaaaacactactttattttaaaacgggaatcgggctgcctacataagaacagcccttgcagttagctcgcaatccttgttttgactggtttgtttttcttgatattacgtaatttaagagcgggtttttccactattctgtacgaaagaaatgcggatgcagcagtaacagcaattagggctatgatcagcgggtaatcagacaatgttttattaattccagtgtataagaagatgttgatgatcaccatgtgccatatgaaaatccccatacttatatcgtctaaccggttcagctgtcgcaatatcttcggcccattgtaaccaaaccagacgagtgcatagctcagaggtacgaaccataaaaagctccataaggtgctgtttattgaactgagatgcagaaggtcaagtttatagaataaaaataaaattaccgaagacaaaaataaaacgatatgctgcggtaacttgctccatgccttagcccagaagatgcccaaagtgaaataaaacatctgcggcaggaaagaatgtaagtacaggttaccgaacacactgccaggcgcgaactttaaaattatgaaagagactaacacactgaaagcggaaacagcaaaagagcaaagaatcatttttgggaatccgaaacgtttataaaaccaataaattgcgggtaacaccaggtaaaagctaatctgaacaggaattgtccaaagtgaatcgttaaggcgacctgtgccgatgtgatggaatatgtcagggaagtattgagggtataacacaaaattgctaagaagccatgtccagtactctttagtagtgaatactgttaatgaaagagctcctagaacaattaacaggatggtggagacgatagcataggtgtatatagcgggtgcgatcctaataattcggctccaataaaaatcggttacattattacctttaagctgagatctctcataagaagtaaaaagaaaaaatgcacttagaaaaaagaagattgatatgccggtgtgaaatattgctttgctctctggggtataaccaaagacagaaatatttagatctcttgtagcatgaccaatcaacacacaaagagcagcaaacagcctgataacaaagaaacagttagaatgttttacgttcattaaaagaacctctttcctataccatatggcgaataagcagtaaggctgcctataagcagtgatgattatatcataaaaatggaagatttgttcttaaaaatgaactaaaataaatatttttgttcttaataaggtatatttgtgtgatgtagggaggtatagatacttataaatacacgtagatattcatagatacatgtatatctagctatatcaaggagaatgcagataaattaagaagcctctgcctgttctttcacctttatttccaatatagtataatttggaaaagggggagagggaatgaaaaagctaatctttttggctgtgatttgcattggttttatattgagttttaacacaccaagtgctgaggcgaagcttacattagactacaaaaatgtggattttcacatgagtgaggattcagagagtttttcaatggcagattattttgatcggaattttgatcgcacttggctcttctacaaattcacaattaacaatgctgaagggtgtactctaaatatgaaaatcagtaggataactcttgctggctgggtatttccacgtagtgagaagcagtttgtagggaactatgctgactatactgctacagatcgagtagagggagatgctaatcgtaatcatgtgttagagattacaaagaatccaggctgcggagatgtgtggattaaaggtatttatggatttgaacatgaagattcatttgattggtaagcttgatacatagtcaaggtatatccttgaccttttttatggatataatgataatttaaagtgatcatacataatgaatgcgaggtagtaacattgattaaatcaaatttaaagccaatattagacgaaaggaatatcagtattcgaaagctgtccaatgatattgatcatggttttaacacagtcaggaagctgtatcatgatgaaatggagcggtacccaagggatctgttggataaagtctgtacatatttagacattgagctgcatgagctgttgatttacaaaaaagattaaaaagatattgatcacttaaagtgatcatggtatactaaagttacaagaacagtaaatacttacaaattttataggtctacataaaatcgtactttcatagggaaaagaggaaaagaaatgttgccaacttctttaaaagcaaaagttcagcgaattttattaaaaggtagctttaaaaaatctgagagctctaaaagcagagtaaaaggactaagcaatatttcagcgggtttcacttttgagaagatgtttgacgacggttactgcctctattatacatgcggtaatatgactttccggggaatgccaaacgaaaaaaaggataatcaaacagaaaaaatgtatcacttcttattggatcagggtcttcaaaaaaatattgaattgacagagtttggaaataaaaaagtaatcttgttgaaagtggaataattgcgagacactttgaggagtagcataaatttgcactttacaacaaagggagagataaaatgagagaggaaattcaagtgttacttgaagaaattgaagaattagaaatggctttaagtaagtccgataacaatactgtttctgtggttcttcaagaggcaattgataaaagacgcaatgaaattggcgaactaaagccaaatgggtacgtcatagcagacgtagtccttaaagacggtaccgagttaaaacggtgcttagtttttactgtaacagatcgactagggtcacaagctgtaactgaattagttgaagcaagagaaatcttcgaaaaagataaagcggtttatttgcaacaggaatatgaggatggaaactttgcaggggatataggagtacacgaaatagcaacatacaaccttgaatatgaaaatggtgttaatgaataaaatcattctttcatcttaattaataaaggagagtacataatgtatagattcatatcagagctgaatttagacgactcgacaattcaaaggatggataaatcccaaagctttaaatacatcggtggtttttatatgtatgatccccagcaaatcgaatggccaatcccagaaggagaatcatcttcgctcagtgatttagcccatttaagttttaattcttatgactgtgaaaaccaaatgatcgcggatatgaaaagggaattcactgaagaaaagttgttaaatatttttaattctgagtgtccagaaacagcttttaatgacgctgcttcaagaatcattgaaaaatataattaaggtgggttttaattggctagagataaagaatgggttaaaataagcgaactttctgaagaagaaaaacaaagcttgactgccggtactgcagttctgctgcatgataattactataatgggtcgtcagaaaaagcttccttgataagaaaaaaaggttctcaaggaagactagaagacaagtattacgaattgaacggtcaaatggttagaattcttttcggaagcagaatcttaaaagtcccttcttctttattatctgttccagttgcaatcgacagggaacaggaagtcgaactaaatctttcaccagtccaaattgttaaagttatgaagtcattagaactgttactagacttagacaaggaagaatttaaatttaatcgagaagagattgtcctattattggagcagctaagtaagaatctagatagtaatggtattgatcctaacagagtaatgaacgagctgttttcaaggattgattaagttgaaatgaaaccagtcttttaaccagttatgtaagtcaggttgagtcaggaatacttttttgaagggttagatatcaaatgacgatgctaatagcagttaaattcgacaatagcatagtaatgactgctgacaaaagagtgactactacaaatagcttgggccgaattttaaaagtggaatcagatgaatataagaaaataaaaattattaataagaagtacgtaatttcttttgcaggtagaatgtttattgcagaaaaagcttttgattttattgatcaaaaaagcgatattttgaacagtaatattgatccactcttattttttagagaagcttttaattacggaaaatcatgttttgaagcatattattctggtattaacccactttccgtattttttgttggatatattaaaccagacgaaagaccacaattgttggggttttcatcagatgataattaccttggattagaaatcgattcaagtattaaaattaattctaactcccctgatcacgaagacatgcttataagcgaaactgttaattttatttcaacagaaatgtcaaaccgtcatgcctatcatgcaaatgaaagacttttagagatttattcggaggcaataaaaagaaccaatgatccaatgatcggaaaaacaacttactctgttatcttaacttctacaggtgccgaagaataccatcattaatgtaaaacagcacgtaaaaattataattaagtgaggagaatgtaaatgatcaaggtttatacaagaggtcataagataccaaaaaagattaaatcttgcatctctgaatgggattattggtcttggattgtagttaccaatattgcaaagaggaacaaggatgcgaaacgactaatagagaagattgaaactgatccagacaggattgcagaatataaaactgaagatggaattgaagtttatgtaagctacatgattccagtgaaatagaaaagagcattaaactaaatgctcttcttcataccacatctacgacactcacgtaaaaacacaccacttttcactgaactcttgaataaagcgtaatcacagttgtcacagcgaccatatttaacatcgggatactccttataatcatatacaactgttacatcgtagccattagtctcaaaatctttctcttccattaaatttcacctacacaaagtatttaacactactataataccagacgatgtatataaggagggttttaatttgattggaatagcatatttcttaatgctctggcttggtgtaggctttctgacaggatttaaggccttatttgttgatcaggtttatgatgaagagtttaagcaggaactgattgattcattttcaccaggtatggagcagaatatgattgaactgttctttaagaataaaataaatatcatggtgttttacatattaattggattgctgccactggccataaaaattgctggtctgctgaagaggagttagctatgcctgttatcgataccttttttgttattcaatttgaaaatgatgattacttcaagtcatttaaattagatggaagtggttataagacatctaagggacttcatggcgcttctaagttcattacaatgtcagaagctttaatgatagcaaacgagctgcgtacagagtttaatgtcacttctgccattagacaaatcgaagttattactaggtgatggggtgttcaggtgtactggattgaatggattgaggatggggagaagaaaagtattgttgtggacggctgggttgaatgggccacaatcctggaagacctttatcagcagcggtttgagtatgttgaatggaagcggctttaaaagtgttgacagaaataaaaatacaactgatgagacataagaacctgaaaagttactagggggcatttttttggacagcagaagtaagatgagatatatgccaattgaagattttccaaagaaagcttataaatacatggaagcgaaatggttgaaaaaattaatgagggacaagaaactttttgtaaatcaccttaataactatccagagtcaagcttaggtgcggatgttggagatgaccaagaaggtgtagcaaacagacatttaaacattaaaaaatataaaacaggagaccataatccacaccttcacaatgaactacaagaatggtttcctgactcaatagttagacttgaagatgtgtcatttcaaacctcaataataaataaaaatttttatgtttattgtttaactttcaattatgataaaaatattatgagaaagtttggaggttcagtaatggtaattaatgattttccaagtttcgcatattgggtacacaataaaatgaaaaaaagaaattgtgccttatatgctgcgaataattgcatatatagagattcaaggagcattacttttaatgaggaaaacactgatttttatttggtgccaggccttattaaagatagtaagcattctgaacaagaagagtttagatttctttggaggaaaaacgataattctttaataaacagaccaattaatgatctttatgtaccagaagcattaaagttttgctcctttgaaattaatgaataaaactttatattgtttttatggtttacatactacgttcaattatacgtattgaatttgcaaactttttaaatgtatttataatcttctttaaggagttgatttaaatgaattgggtatcttacccctcaattttacactatgctaatgatggtattacagtaaccttcccagaccttcctggttgtataacttgtggagaaaatgatacagaagcaattagcatggctaaagaagctttaggtcttcatttatacgggttggaaatggacggagagaagtatcctagtccctcaccgttttcggaaattaagacaggggaaaacgaagttgtgtgtttgattgatgtgcctatgcatgcatttcgtgatgagtataggcgtaaatcaattaagaaaacattaactattccggcttggttaaatgaagtggctgaagaaaagaacattaatttttcccaggtgctgcaggatgcattaaaagataaactaggactaaatatctttaaggcacagtaaggattcttattgtgccggttcatataaaatacgaattttaaacagataagggttccttaaaaaataattagaataaaaataaaataaatacttgtaattctgacaactctaatgtatattataaacaaagggaacattagttgggaaggggtgtagtaaccaatgaatcttaagcagatgattaagaatgaatgtgaaaaagacaaccagctcgcagcgaaactctcaaaaatagcagggtacaaaaaggttaatggtttttacaaattcatcaacaccccagagaaagaaatggacaacttaggcggtttaattaatattgttaaaagcttgtttcctgataatgaggagcagcttctaagtgattacttcttatcactggatcccaacaaaaaatgtgccagacaatctgttgaatactcagatattaatcaatgggatacgttaacagacaagatagtgtcgaggctatctagctcaaaaaacctagcaagtcaagaatggggcaatatatacagtatacatagaagattgagcgaaagtaagataagtttaactgatgcaataagagcaaccggaaagtgcaaaacagatgaaatgttatttttctcaaatgctatgctgatgtatgagtatttgaaggtaggcgaatttggattgatgaaaagcacattatcacttctcaatttcaacgacttacccgaaggctttgtgaaagattgctatatgaatagaatttcattattaaatgcaaatatttatttaaatgataatgaaattgaaaaatctaggtattattcagaacaagttattcaaaattcaaatataaatcgactaaaagtatttgggcatctaacatatgggaacacattaatttttgaaagctactctaaagccaaagagcagtatcttaaaggattggaatttgctcgtgataatgaacatcataaatataagctgcgattagctctttgctttttaagcaacctatggaataaggataataaatggcttgacttcgacactgataatatccctgataagattgaggtagcatattactatactaataataaggaatttaataaagcagagaaagtaataaatgagcttgagaatatggaattgtacgaatatgattctgggattctagattacattaaggggattctataccaaaataagaattatttttatgaaagcactgcaaagttgaaaaaatctggtgataaattatttatcaatcttccattagcggagctaaggaaaatgggctgtgacgaaaaactacttgaattaatcatggtctaaaattgaaggggggtgaattaaatgaaaaatattattcttggaatagtaatcttgttagcaatggctgttggatttgttgccggacagcaatcaattgagacagcatcggtagaccatgtagaccagcctgtaaaagttgcatcaccaagccgcggggcttaacttcaaagataatacataacttggctagacgtttgatccactggatcaggcgtcttttctaattttaagagaatgttccagaaattcataatataaaaaacaagaacatgggggaattaaaatgaaaaagcatttcggacaagtactttcttatgaggatatggctaaggggtacatggaaatgggagatattaatttagaaatttcccaggaagataatcatcttgaaaatgaagcagaaatggttagatcaaaatataaagcaaaggtatcctaatgaagattaaagacaaatcagcagacattttaacacatacataggggatgtgttatttgtcttgaataaaaataaaataaattgttgcatattattctagcaacatatataatgaagttacaagatgaacgttgttgggagatgaaacaatggaaacaaccagtgccactcaaaaggaagagttgaagattacatcattaagacaatatcaatacataaaacaactaaagaacttcacacgagtcaatctccacctagaggatccagatgtgtttacacctaataatgtaactacaatgagaaaaaatcataaagaatacaacctcattaaagaacaaaaaaattctataaaatgtatttaaggagtaaaaataaaatgaataataaatattatacagaagaaaacaaggctaaagtttggaaaaagcatatgatcgttttaaagtttctagagcagcctgagatagcagtagcttataatgagttcctacgaagagaagcgacaagtgatgaatgggttgggttcgaagaggagctttatgaggaattgacggggatgccaattataaacgtctgtaaggacgagagggtaaatgtcctaaactgaattttattataggataaaaataaattaggtgtgataaaatgaatgcagacatcttaattaacgctcttaaagaatacgacatgttaaagcaaatggaaatctgtaacgccaatataatgctgctgagtaatattcaaggtgagaatgaatggattgttgcgtggaaagaatttgatcaatacttaatgaaaaaaatgatatgaggtgtcattatggaagctcaaaagaaagcgtcaacactaagggattattcaatatacaataacataaataggtggtttgatgaattagatttaagaaacagggatcgagaaactggagaaattgaaaagtctaatactagagccacgtatgaaaggcatataagagagtttttcaaccactatgctgccaaggatattgaatatttaactgagagtgacctggcgattaagaagagtgacctgtatgattatcgaacccatttggctaaaaataaaagcaactccaattcaacaattaacaataagattgccgcactgaaaagtatgattaagtaccttgaatctgaacatgagtgtgatgcatctgtatttaattttagacctcttccaacagaaaagaacccagcaggctcttttgaaggaatatctgaagctgatgaatttgctgaggcagcgtatgttactgagcgtcagaacagattaatgaaaaagatgtttattttgtttagtgcacgtactggtggacgtaaatcagaggtacttagagttgggtgggatgatattacttattcagaaaagcaccaatgctatctcgtcaactttaaaaaaactaagcaaaaaaaggctagaccagttgggatttccactgctttttatgaagagttattgctgttaaagcaagagtatggggaacatgagcttttatttcataagttaacagttgattcaatacaggatatgtggaatcgcgtatgtagagttatgggcattcccaaagaaagaaagataactccgcatagtttacgcaatactgcaacaaacttttcttacagcattaatggtgatattaaaaaagtggcagcgttctctggccacagcaatatcaatactttaaatgaccattatttagtcaatgaaagggattattctcaagatccaggggttttggttgatcaaaaagaagacatgtcctttttagatgatgttaccttagagcaatataaagaattctttttaaaatcagacatgtatatacagaataaacttaaaatgtttttgaacaagtgatacaaataatcatataaaagctttacttgcttatgaaaataatgataaatttaatatgattatgtgaggtgataatgtgtctgaagttttgttgacaacggataaactttataagttaaaaactgaaatagagaaaaatcttaatgatattaaaaatgatcccaatatggtgaaggaattaaaagccacaatggcggacaaatacaaggcactccctggttatatccaagaaattttaaataataatgataacaacgtacagcgtttaaacgaaaaagaagtgtacattgtttcaaaagagttgtattcaattcttgggacgcaagctttagatccgtcaaattattttccaaccagattggcaaaagagcttgaaggtgggagagtattcgccggtgaagaagtagttaagctcccctacaagtttaaaaatgtgattaaaattaaagaggataactatgtcacttccattactgccaaagaactgagtgagttatataatagctccatcctgcagtacaattacaacactcagcgagaaggaaagtacattaagggcagccttattcctgtacctaaaacaaaccctaaatcagttgatgagatcaaagaattgtttattaaaggcgatttaattgtatcaatgttaacttttaacgctcgtcttggaacatctgatggtgatgaagaagttgaatatgattcaagcgaccaaaccctcactgtaacacgaggaaccttattagatgctcttgatggatatcatcgaatttcaggtattgttaaggccattgctgaagtccctgaattagatcaaccattcattttaaatgtgctcaattacgatgaagaaaaggctaaggttcactttgctcaaatgaatacaattaacccagttgaaaaatccagaattgaagaattgggtcaaaaacggtattcttcaaccgttgtcgagcagctgaaatttaaaagtgaacttaaaaataaaataagcccacaaagtgaaattgctattgatagcaattttcttgtaacatattatactttatccgaagctatagacgatgtatttgagttgaaatctcgaaaagatgcgttgaaaattgcgaaatacttggtagacttttttgataaccttttttatgcattcccagacgaatttcttgaagatgatttatcgtccattagaaagcaatcatacattaatcataacgtaatgttttacggttatgtttatttggccaagaagatgaaggaaaacaatgtagaactaaacaagcttgaaaatatccttaatacgattgactttagtaaaagcggaagagtgtttgaagaattaggaagacaaaataatgagaatcaactaaagaatattatgaagaagaaacttaagcgaatgttttatgatgaaattgctgttgtttaaagcctaaaggagaatttaatatgagtgaaatatataatgctgaattgaaggaaaagtttttagagaaatacgaaagtgaagcaacaagaaaccattattggctaaggctaagggatttctcagctacagaaaaaatacttcaaaaagacatatttaatttttctttggaagagctgcgtacgttatttttagatttagatagcaaatctatagattcactaagaggagcaagagctgtaattggacaatacacaacctgggcaatggaaaatggcttggcaaacagtaacatcaacaaagtgtatcagatacaggatggtgacttaaagcagtttatagataaaaacaaaaaaacactattcaccaataaagaagtagaagagtatgttgattttatggttaatgatcaggataaagcgatgatacaggctatttatgaaggcatagatggctatcagcattcagagttactgaatttaacaggtgacgatttacttgatgataacaaggtaaagctgatagatgataaacacggtgtaagaataattactgtaagcgataaatgttatgagttgcttaagcgtgctaatgatcaaacaacttatcatcttagcaatggttcgccagatagtggtcttaaaaacaaatttgctacattagttaaaagcaaaaacatttttaggctaaaatacaagagttctaatcagagtatgaaagctgacaagtttttagttcaccgatcttttagccagtttcaaaaatttttagaagaacccttcttttcacctaagaaccttatcaactcaggaaagctcaacatggcgtatgagatatacaaagagaagggtgaattaaaagtacctgattataaaaaaataactcgacaatacgggtttctgaatgaagacgcggagtttaattcacaatcactgaggaaagtagtgaatatggataacttagaaaaatattgtatcaagtctgaagtaattgagactaattcttaatccctgttgcagggattatctttacataacttttagagtaaaaataaaacatgtgcggataaactcgtgatattttttcgaaaaatatcaggattttgttcacatttttcagaattcgacaaagttagacagagacaaatttgtacatatgcagtaaaatagttctataccctaaaaagggtacaaggaggttcgctaggccaaactccctagcgataaagtcaatgtttgattttccattcatagagatcttcaattgaacagttaagggcaatagcaatgattttcgctgtttttatattcatagaaggtctaaagccgtttgcatagtcacttaatctttgcgtactaatgcctgttcgctttgaaagttctcctaatgacattcctttactttcgaggagaatggaaatcaaacattgtccgatttcaacctcaagcatcggacaacctcctgttatagtattgcttatcatactatatcaattctttccaagtttttaaatgaaagaaaaaagatttgccactaactaggtaaaaggttataattaagtcaacaaaaagggaacataagttcggttaattactaccagagagagggaaacgtatgtcagaaaaggattattttattcaaggggagctgtgcattcctttttttggcaggataaaagccaagaatgaagaggaagcactcttgttcgcatatcaatcaattaaaaagaaattaagaaacaaaacagggaaaatggggtttcttcaaaaagatcaagaaaaatatgaggcactatttgatgtagacatcatgtgtacagaggatgctgaaataacaacctcttatgccgaagaaatagacgattcgtttgaaaatgaaggctataaatcttctcaactgttatcaataaaataaaagcacatacacatcttgtcagtcatcatgagacataaaaaattggtgactttttagtcagactggagcatacaatggattttaatcttgaaattgacttgaaagacattatgagatcagtttccatgagtgttggttctaagaacatacaaagtggagagtactacatagacattatctttaaaaacaatggggattgtttgaggattagaatggatcatgcttcagttttagaatttagagacaaaataaatgaaactctttggaaactggacggcatgaagacgtttatgaagacagcagctttacagtatgagtaaagctgatttttttaaaattatttagaataaaaataaaataagtatttacaacatatggttgaggttatataatcgaattagaattaggaaaggagatagctttaattattgattaatgaaccaactaataatcaaataagaaccatggttttaaagaaatatgcaaagctcttagcgtcatgtgaaaggtcattgcgcagcatagagaataacgaaataagaatggcaattggagacctagattttgttaaagacaatttagaggaaatacaatacatactccgtgatgttgtgaatcagcatgaatgtattaagagtaaaaataaaatttaagttttatagagattaagataagggggaataacatgggtgcattaatcgctaagcaaccgaatggacggtactgccgatttagttcagtggtagactgtccaacgcacataaatatgacgcgtgaagactatttaaataattttactgggacaacaaaaggaagggaagatgctgaagatacacttgcaaattatctccggccgtttcacgaagttataaagtggtacacaccgctgaacatgagcgaaaaagagtttgtggaggcgttaaaagaaatgtgtgacgaaaacccaaaggaggcgcgggaattgtgaacacagcatacagggtgtgggacggcgagcagatgcattattgggatgatgaagggttgagccttaccatcaaaaataacggtgattggactttgaaacgtttatacacagatgttttggttcccgttgtagacagcacgaatagaaacgcggctctcatgtggggcacagggttgaaggataaaaacgaaaaaatgatttacgagaaggacgtcataaagtttaaatctgtctattgcgaaaacaagattataaaagcagtggtcaagtttagagattctcttgggtcgtttgtattcaataggggagacgatcaagacttttggagaatggacgtatccctaagtgaaatcgaagtcatcggagacatttatcaaaatcctgagttattggagggcgcggagtgaatgctgaagtaaagcgtgttgaatataagctgtggtacgaagttaagtacggatggaagcatctcagtttcggcgccaatgatgataaaactgcattggaatacgcagaggaatacgcaaaaaataactacctcataaattataaggtggaaaaaataacgaatgagagattgttttggactgaggagggcgcggaatgagtaagaggtctaccctgttattaaggaatagtgtgaaagcaggacaaagagaaaaattcattacaaatggcattccctatgatgaacttgatacacaaatgatcaatttaattgatattttgaatttcatgattggattgaaaacacgccactgttgttttggacataaaccatatgaggaaattcaagtaatgtttgaagaagaagtaaatttaaaagaagatcaaattctagagttagcggaattagcagggagagaatggaaaggtcttcagttaagctttagcaaatgggcgagattttctccattgatgtttaattggtcattggtactatcgaaaagatttagagatccagaagatccaaataaaaaccgttagctaagatcagttgaagaattctttgagagctatgctgcaaagaagtgattaaaagatgcattttaaacaaataaaaatcagaaaggttgatagaatttgagaacattagtgttattaagaggctgcccaggagtggggaaatcaacttggatcaaagataatggacttgagcaatacacactttctgcggacaacattaggctactgtttcagtcacctgtgttaaacaaaagtggaaaatatgaaatctctccgaaacacgataacaaagtgtgggatttattaatgaaattgcttgaagacaggatggatcgcggcgaattcacaattgtcgatgcaactcattcaaaacaaagtatgatttcaagatataagccactagctcaaaaatatagataccgtgtacatgtagttgatttttctgatgttgatgttcggagaatcttaaaaagaaataaaatgagggctgaacataaacatgttcctgagagtagtattctaaatatttatgaaagaatgacaacagaaaaagtgccatcttgggtaactgttctaaaaccagatgagttcgaaaacacgatgacttataagccaagatgttttgacgattataaaaagatccatatttttggagatattcatggctgcaatactgtgcttcaagagtacttaaacggtgatttaaatgaaaatgaactatacatctttgtaggagatcttatcgacagaggtattgaaaatgcacagctgttagaattcatgatcaaaattaaagattataaaaatgtgattattctggaaggaaatcacgatagatatatcaatatgtatgggaatgatgaagaaacacctagcaccacatttaacaacaaaactaaacctgaaatcgaacaatccaacattgataaaaaagacattagacagttggccaggaagtttcatcagttagcttactttacatataaaaacactacatacattgtaactcatggaggagtttcaaccgtacctgaaaatctcttgatgaccgcaacaacacaattcatcaatggagttggagattattcagacgatattgattatgaatttgcaaataatactgcaggtcaaaatgttgtacagattcatggacatagaaacatgtaccgtctgcctgtgttagcagcagaaagatcatataacttagaagggcaagtggaaagaggaggtcatcttagagtcgttacactgtctgagaacggaattgaaacgcatgaagtgaagaataaagtctttaaacaaatttcaagtgaagtacagagtaacagtgcaactgttggaacaattgatgaattgatttcacacttacgtggtcatgaatatgtgcaagagaataagatgccaaacaatatctcttcatttaattttacaaagcaagcatttagaaagaaaaagtgggatgaaacaaatattaaggcaaggggattgtttattaatactgagagcaatgaaattgtaagcagaagctatgataagttctttaacattggggaacggtctgaaacaagaatgcatcatctcgtggatacaatgaagtttccagtaacagtcttcgataaggcgaatggatatttaggaactgtagggtatgactctttgtcagatcagttggtattcacttctaaatcctttacgtctcaattaacaagtgaacatgcaaaatgggttgaagatatgtttttcaagtcctttgatgaatttaaagtaaatatcattaaagattatctgaagctaaataatgtttcattcgtttttgaagtaacacttccagaaaaagatccgcatatcattgaatacagtaaagacaaactagtcctattagacatcgtaaaaaggcaaatgacgtatgaaaaactcccttatagtgaagtgaaggcagttgcagagagtctttccattgagtgcaaaaatcaagttgcagagtttagtaactggacagatttctatagatggtatctggacgtgtcacaagacttttcaattgaggaagagggttatgtaattgaagatgatgccggcttcatgacaaaacttaagctcccttactataacttttggaaacaaatgaggggattaaagcataagatcagcaacaaacatgagcatacggttaatacaggaagcctttacactcctttgcataatagattttttgcatgggctaagacaaaggacagaggatatctaaagtcaacctccattatcaagttgagaaatgattttgaaaaagaaactgtggtaatggaatccagatgaattcaagataaaagtaaaattttaaagagaaaggttgatgggaagatgaaatttgcaccaatggataaagttaaatttaaaacagctagccatttcaacaaacttcgaacatttaaaaaaagagttcctgaatttgacgatcctttactcggtgattgctgggaatttgaagaagatgggttaaaacaatttgattgggaggagaattacgaatttgtcgctaggcccaaacattttaattgggattaaaaataggatctaattgagtttttaatgaaaaggagctgttataaagtgaaagatatccgagttgtttatgacagaaacaaaactttagaagcggtcgttgtccagtttggagctatatgtgtgagctagtagaatcgcaattaattgatgaagaaactaaagaattcgacgtacttaatgatgaatatcaaggaatttggaaatatgaaaaagggcaacactgcgaagtcgaaatttatgatggggtagacaagtgggtttgtcaagcattattaaactgaataaaaagtaaaatgttcttcagatgatataaaggaggggaaataaagatgagggaatcacaattaagggaagaaaatgaaaatttgaaaaggcaagtagatcatatgaaagaagtctataaagaaaatatgcatcttcatatggcagtaagacaaggtgaacagttaaaagctaacctacaagcttatttacgacaagatgaccgagtatatagtccccatttcattacaccaaaacaaaaacaatatatcgcaaatttgttcaaaaaacatggcttgtctccactcagtaaagcaaaacgaaaaatagttaggcgttttaatgggggcggtctgctttcagagcacgaagcacatcaaattatacaaatgtatgaaagaaagtaatgttaatcttgacttggctggttcaactgtaaacaagaaggaaagagatttttaattgtagttatacagtcacaataaaaagactgttttaaagaaagggtgagaaccgatagtcactttcaaaaaacttagtgatcctgaatatattaagcagatggaaattgaaagaaatgaacgtgagcggatatatcaaaaaaaggagactttaagaaagaaaacggtgtgcttcactggtcataggccgaacaaattgggtggatacgatatgaaaaatccaacaatgcttaaactcaaagataagctgcttgaagtaattgaagaattaatcactaaggaaaacaagtccagtttcataactggtggagtgttaggaactgatcaggctgcttgctggtgtgtacatattctaaagaagaaatacccacatattaaaaacataattgcaacacctttcaaagaacaagataaagtgtggtctgaagaacaaaaaatgtggtacaaacgtatgcttgatgtggcagatgagattattaatgttgaagaattagataaatataaagttagtggagctgtaccaggtgagttttcaccggctaaaatgcaaaaacgaaatgaatacatgattgatcacagtgaagcaatagtagctgtttatgacggaagtataagtgggacaaggaactgtctgaattacgctaggaaaacatacttaggacatcaaatttggaggctgcatccgaaatgtgattttgaattggatataagctatacgcctgaatgaggagggatataacatgagtgaatttaaaattgtgaatttagatggagttaattggggatcgcataatgacgacacgttagatttcaaagaattgattacaggaggaacgattgcagtaggcgacgttgttaaagttgaaggacggggcgattgcccacttcctctaagggagaaccaactttgcataacatttaacaaagaaaatgagttgtttcttgaagaaccattcacccaagaagaatgcaaatcattattcggatcagattttagctactaagcaattactttaaaaggattatttcaatgaaatgaggtgggaatttgagtgagaactataaagatccgagacaagttgcgcttgagcttgtaaagaaagcaagtgatcagattcgctataccaatgatgatgaatttacatttgaagtggttgataaattggaggaaattgaggatatgcttaagaaagatattgataaagaaaagaagaattcattgaaaaattagttgaaaggatgtcgttagcataggatacatcaaatacataattgatacagcctggtttaacttagtttggtttaagtggcatcttggagcggatataagcatatttgatggctgcggatggaatacatataaatatttaaagggtaaaaataaaataagtggaggttataaagatgataaagaggaatctgcttagcaaccacgttgatgagattattggtgaatattacgctgctaaaggatattcagtccatagcattgaccgccaggaaaatggacaactgatcgttgttacagagcgagtagcagaggagaaggaaccggcacaagtcgatattgcgtttgattttgtacatagaagaccacataagaagaagtatttagcttaaaaacggcaaagagtcaaagctctttaccatcaggtgatttctttaaccgattcgcaatgtacttcattacgtttactgcaatcgacactaatgcaataatcaatgctatttcaaataagaggatgtatccaaaattcacattaagcttttcaaagtaatcgctggtaatagagaggattttataaatccctagcataaaaacaataaaggaaacacctaaaattacaagtgactttatagaataatctttagtatgttcaaaattatagataattattgatacaaataacaaacccgtagcaatcttttgggttagcgaatcatcggccgaaaatgattgcactactatgctgatgattaatccagcaataccgattgttttattcaaggaatcacccactcgtatgtaagttaggtatgagtttaccaattaaaggggattttctcaaggcaatacacattaaagttaaattaaaatgctttttaagaaaggggtggaaacatgcttggttatcagaaagggcagcaagtaagatggcatgaaaatggggaaatgggaattatattgtgggtgacaaatcaaggctctgtaggtgttaaatggagctcgggtgaatacggtgaatacaattataaagttgatgagttattactgttaacagattagtatcttacccaaaagtgtgaacgcatgacagcaagaaaaaggtttagtctacataaaatcgtgattttaaacagaataggaggaaacgaatgaatcaagatattcagtttttaaaagaacttcagcaagagttgaaaaatcaagacaacgacggacaagctgcaccacgtttctggacagttggtgattatgaatgggtcgaagctcgagaggaaaatgcagaacggtattctgtatacctgccatatattgcagaagcatatgttttagatgattatttggaagatttaaaagaagatagtgagctatctaaggaagcattaacagagttgaaaaatgacgactttgatgatcctattgagtggattcaaaaatacattgatgaagaagcagaattaattccagaaagaaaggttcatattgtacggccggatacaatgtttttgaccaaagaagaagcgaagagccacatcaatttgaacaagcatcactacacttcagaagctcatacttatgcaatgacagcttggagggcaccaaaagtagagcagttgcttaacatacttgaaacgtttgattggaattcaattaaagacagtcaatacaatctataaggggtgggaaaatgaatacatatgtagttacaaaagaaactgaaaattatctatatgaaataaataaacaaattgtttatgccggtaataataaagatgctgcctttggtcataaacctgaaacaagtgagagcagactaattttagacgtctggtttaatggcctaattgttaaatcattcagcagaaatcctaatggaaactggcgcgttttatttgataaaatggcaatcgcgaagaaagaagttgaagactacagcagaaaattaaacaaggcacaagagcttgtagagatgatagagagagctgaacaagtctagataaaagataatttttaatcagttattaggaggaaacgaaatgaacgtaaatattaaacggttatcaccggacgcacagattccggcttatgcgcacgcaacggacgccggcttcgatttagtggcgtcagaggacgttattatcgaaccgggctgggcagagcttgtgccgacgggtttggcgttcgagattccggagggatacgaaatgcaaatccgtccgcgatcaggcattacgctgaatactagactgcgtgtgcaactcggaacagttgattcgggctatcgaggagaggtcggagtaatcgtcgacaatataaatcgttatacagatattgaaaaggactttcttttcgatatcagagataaaatcgtcagtgctctcgattacctcggagcttgggatcattttgcgaaaggttcgtacatcatccgaaaaggcgatcgcatcgcgcaagccgttatcaagccggtcgagcaggtggtatttacggaagtcattacgctcggcgatagcgatcagaatacgagtcagttaatttaaagtctgaatcgacgcttttcctcaaagtcttcgggatactcattctgctttgacttggacttgaatacaaaccaaattatagcacctagtgaataatccatgactttatcaaaaatccaagttgtgaagagatccataagaattttcattgcatttcacctcccgagacaaaaatgtcctatctctcttagatggcatgtgtatgacacgcatctattaataaaagagtgaaaagtaatatgaaaatcaaaaaagaattgaaaaaaataaaaaagaggtgaaaaaatgatcaaacaagaacgagaagattatataagcaggcttgatgaatatggattgacagaagaaggggatgagggaatgacgaatattttgaatgattttgtaggctatgacatttggtgattatttatgaataaaaataaaatagttatttatagaagggaagggcgcagatggcaacagcagagcaattgaaacgaatgaacgacataaacgatttgatcaagcttatcgcaagtattgatagatgtactttctactgtaagtcaaagaatcggatagcgtatttcagatttaagaaaaaactgttcttcgttgatgattacacgggcgctgacgtttacccatatgaattgggatacgggcgtgcaaatggtttttcgcatgggggcaacatgtggcaactagtcaacagcttcagaaaattcatcataacagggaaatacggcgagctgagggattataaagaaatatgggcttacagctatgaaggttgtatgaaaatccgtcagaaggcgaaggagatcggtttcattgaaagtgttgattacccctacagctttgctgaatgggcaagttaaactaattgattcatgtactaaattttcatcaaaattaattaactttgagctaaggaattatgtaacggagagattagactctccaggattcaaaggaaggtatgcggagtttaccatgcttagtcttaaatctgtgcttaaccttacataagatcggttctacaaatatatattcgtcagtttcagactttacatgtttcatagagtggaatttacttcgttctgcgttcggcatgaattccattattccggctgcagtaccatcaggataagacagaagaaattttatatcctctttggtgtagccggtgataagcacatctgtgtaatcataattaatcactttcagccagctatgggaacgtttattgatttcataaggggagttagctttctttagtacgattccttcaagatgcttttctttggccagattaaagtaagctaatccgtttccttgtagaccttcgattacaaatacattatcatggtcaaggtttaggtctgaaagcatactcttacgttcagtgagtggcttagtagcgattgaatgaccatcaatataaactacatcgaatacacagtaaaccaccttatgagctgatttcttagacataaagcgttccataacagcttcgaaatctggagcaccgcctggggcagctacaatgatttcaccatctaaaacagttccattgggtatattaagatctaacagttctgggaacttgcttgttacttcgttgttgtgacgagtataaagctttatctgatcattaaacttggagaggatcagtctaattccatcaaacttcagctcggtaatataatcatcgtcatcaaatggttctttgattgaatgcaataacattggcgatacaaacaaaatatcacctcctacttagaacataatagctaagcgaaggtgatatataaagcaaaatgactgtggtacttaatgggattcaatcagttccggtgagttgtttttaggcgagttaactaaggatgaaacttgataagcttccatgtcatcagcatcatacggaagcagtaagctttgaagataatcaggatcggtgtttttggggtttagccattccttttcgttcttgtcagtaagaatgaccggcatccgatcatggatgtcctccatcaactcattgggttttgtagtaatgattgtgcaggtatatagcggattgccttctggcgtattccacttttcatataagccggcaaatgcaaagaggttggatgatttaagtttaatcctcataggaaccttagtctttgggtcaagacgcttccattcataaaaactgtccgcagggatgatgcaacgtttgctaacaagcggttttctgaagcaaagtttctcggccaatgtttcagctcgagcattgatcattttatagccgatcttttcatctttagcccaaggagggataagaccccatcttagcttacccagacggttgtttgatccatcattaatgattgtcaggatgttctgtgaaggagctacattataacttggatggtatgcgtcttcagacaaaaattgatctatattgaactgttcgatgatgtcgtcaaactcagaaaataaagtgaacctgccacacatgttcatcatcctttagggttttttgaatattgtacaggcttgatacacgaaaatcaaaaaggaggaatgtgatgcagcggcaaacagttgaggtaaaagaagttgtagtgttgatcagagggatatggacaaagaagaagttcacggatattgaaaaggggcaaacctttaagattgtggagaatggaagagtaaagaaatacatagcaagaacagatccttattgggatgagatgtacgaagcctacataattgatttatttgataaaaataaaataagtggatgtgagaataatggcgatcaatttaaagattagaaagaacaaagcagataagccaaaggtgaaagatttagaggacgggtacttcattaaaatagatgatgctgatgtatacattgttagaacactagacagagagtatgccgctaaagataaacatgaagttattcttatcgatctgagcaccttgcaaatagcgccatacaaggatatgaaggaattaaaaagtaggctgtctaacagaggtagcacagttgaagttatcagacctaaacaagcaaacgttaatatcggttttgagtggagacaataaaaggaggtggagagaatgagagatattaaatttcaggcgttggtagttaaacatacattaagcaatttgggttctaatatgcattgggcaggtatagacagttacgaagaaattattgatgttcatgacatttcttttgataacggaaaaatagattacgttacagataaagacggtgatgaattttcgtttgctgataaaagtttgaaatcggttcgacaatacaccggattgaaggacaataacggcaaggagatttatgaaggggatataattcggattactttcgacaccacatgggctgaagaaccttattacgttggagaagttaaattcttggatagcgaaaactatccagcatttgatttaaggccttggattgattgtgagatgaatgctttgagttggttaaaaagcgaatcagacccgactgtcatcagttatgaagtaatcggtaatatttacgaagatactgagcttttcgaatctaaataaaacagagattttataaggataaaaataaaattaaaaaggggaaatttgatgaagctaattggtattaaaacaagtaactgttttttggtgtctgacaatattgaaggaaagaaatattttcatagtcaattagatgaattgtttttcgatgggaaacgagcaactgaaacgtataaatcagactggtttaagcttgataaggagccaagtgttattgaaaaacaaatgcctgctaaaaaaatcaatcataggtatgaattaaaagaggggttccaggaaactgatttgacgccacaagtaattaaaacttcttacataggtgaagacagtgaatactatgaagtgaagggtctatataatttaaaatttgaagaagtcccgcaacagaatcaaaaaattgagtttgaaatgaatgtaattgaagaaattgacggagaacttaagttgcaaagccataattttaacttgaattataacttactggatagaattcaaactcatccaatgcttcttgaaacaaagccgtgttacttgtcccgagaagaaagctataagattatcagaaaccatataaaagccaatataaaccctaagtttgcaagaatcacgagtgattatgatttctgtttaactgtggtcaaagttttggagctttgcaaacctcaagagtacgtagttgatctaaatacaatgtacaaacgtagaaagcctaaacttgagaaaagatttcaaacaaagcgggaagttgaaatttacaatgttgcacctaaagcctatcagagctacccaattgtagaaccgtttagtggcaaagatgttgaggatttaaagggcaatattaagaaatttctagatgatctaatggataaaattaatgagcctttagtcgaatgtaaatgctgcgaaggaagaggggttatcttaagtgaaaattaaattggacaaagattacatggtaaatgaattgcggctgcctgaatcctcaattttagaagaaatcactgatacgtctaggtggagtattcattatcgtattgtgtttgcatatcaagacaagttttatgagacaacttacagggaaggcgctacagagttacaagaggagagaccatgggaatacgatgaccaggttgagtgttttgaagttgagcttaaggaagttaaggttagaaaatgggtaagaaaagaatctaaataataaatggaggcggaagaatgagagaaatcaagtttcgaggaatgggcatcaacggagaatggtattacggcaatttatcaatcattaagcaaagaatcaagagtatgggtattgatcctggttcttatatctctaataaagctggtgttccatttgcttacagtgtcaggccggaaacagttgggcaatacaccggattaaaagacaaaaacggccgagagatttatgagggggatattttaaaaagaacagtcacggttgtcatgtacggttcaggcaaaccacctaaagatattgatgaatacttagaagttgagtatcgggaagattatgcgggcttctatatcggagaaaggccactgtttgcttatgtggacaatactcgtgatgtcgatactggctgcagatgcagcaaagcagaagtcatcggcaacatttacgaagatcctgagcttatagagtctaaataaaaacgatatttaaccagatagggagatgtttaaatgacttcagaagaagcaagaaattattttgtgcaaaagggacttagttatgaagacattacggagggagatatttgtgctttagttatgctactcaataagcatgttaaacaggcagttaaagcacatacaatgtctgttgatacaatgagaatgagtcagaaaataaaaagcaaatacaaaacaaatggaactttaaaaagttgttatctttacataaacagtcactattttactcaaagagaagcaattagttttaatccagatggttttattggtttcgcagggtgggcagattcaggcaatagacaacctataattagtgcttttactgaatgggttgattatatgagtgaacagttaagacaaatcagttaaaagtaattttttatttaagggggtgataacgatgtgatcgatttatatgatttgagttttaaaaataaaacaaaaataaaaaggagtggttattaattgttgaggattaaaaacaaaatagaggaattgctaaaaaagactaaaggagcagaaaagagagactttggacggtacactctaatctgcacacttcgcaaggttacgaagctattaaagtatatcacagaaaagaagtcttttccagtattggtgacagcattggtttcgttcatgaatccaatcagtatcttagcagcggacaagtatcggaactttgaagagcttaaagcgaatgaatcaccgttcaattttagcgtgttctcaaaagagcaagacactgatgtattaattcttgctccccatggaggtggcatagaagggggaacaagcgagcttgcaaaggaattaagcgaaacatactctacatatctttttgaagctttaaagacaccaggagcctttgatttgcatttaaccagtacgaattttgatgaaccacaagcacttgaaatgttgaaggggcatgagttcacattgtcacttcacggttatgcaagtaatgatcaacatgttctagttggcggcacagaccgggacaaagctgaagcgataacaagtacattaaataatgccggctactctgcagagcttctagatgagggtacgaggctatccggtagcagtccaaataacgtggccaataaaaataaaacaggaaagagcattcaactggaattgagcactggactacgcaaatcaatgttcaacaccttttctctgaaaggacgctctggtacaagaaatgagactttttataacttcattgacactctatcagggtttctcaatgaaaatgtagaagggaagggtttgacaacatgaacatgcaacagcccttatactattttgttgatgctctggattggggaattgatgataaagggtcaaatgcaattgaaacaacagaaggattaaaccgagctttagagtatgcatgctcaaaatcattctataaagtatatgttccaaaaggtatctacctaattgatgcagtgaatacgtcaaagcggttacctgaattcggtggaggtatcaatgttccttcgaatattgagctaatacttcatccagaggctatatttaaagtgcagccaaatgattatcagggttactcctgtttttatatcggccaagcaagtaatgttacgattcgtggcggtcaaattattggggatcgacatgagcatgattattcaaaaattacctcaattaagaagacgcatgaatggggctttggtatccatgttaatggaagtagcaatgtgctaattgaaaatgtacaagtttctgactgtattggagacaacatttggatagcggctgatggaatgatgaacacttcaggaacatatacgccttcaaagaatgtaaccgttcgaaagtgtacgcttttaagaggaagaagaaataatctggctaccaatggttgtgaaggtcttcttgtcgatgactgtgatatagaggaagctggaggagatacaattgggccacaattaggaattgatttagagggctttggagaaaacggaattaaatacgatcacccgtataaattaactgtgcgaaactgcagatttaaaaacaatggacgtggatctgttacagctcacacaagcggcaaggtaattattgaaggaaactacagcgaccatgttatttcctatggatatagcacggatgtcagtatcaaaaataacaagatcatcaatgaaaatgaaattaagacttatggaattgactcggtaggtgtttcaagtactgagtctggaaacagagttcaaattgatggcaatacgattagtggctttgaagtgggcatttgtgtaagaggaaagggtggcacagtatcaaataatacttttgaaaaaataaaagcatgccctattgcaacacatcaagcagaggactttttaattacggacaacaggatagaaaacagtgattgtgttcaagtccaggttagaaactcaaatgatattaaggttgtgaataccaaaggaaaaggaacgagctcgtcttatgctgcaaagataatggactctacccgaatcagtctcgttaataatgagtttgctaatgtatatggtggaatttattgcgaaaggtctcagtcagttcgtttaaagggaaatgacttgttgttaagtgggagtggatacggcatcttttgggataaagactcttctgtctcactgcatcgaaatgaaattcatgagcctaggaatgttgcaattaaaggcacccctgagaaatacagttgccagattagtgagaatcaggtttatttctgtaaatcattaatcgccatccaactgactggtggttcagaacatatattaaaggataatgagatcatgttcaatcgttcagcagaccaaggatatggtgtttatttggagaatacaaacaaggtacgtctcgtaagaaacgatgtgcgcggaattggtggcaagttattatcccacccatattgcacagataaagcaaagaatacaaccttaatttataacacatatgacagtggaacactgaagactgcagaaggagatattgtggtctaaataaaactgtagttttaacaagtttaggagatggatatatggccaatattttaaccaaagaacaagatgaagcaatccggtatttcaagaacaagctgaacatatctgaaaaactgtacatatccctgattaattttaatctgcttagagataaacacgaagactttggtaatagactatatgagctttataagacagacccttatctgtatatcagagcgcttaaagaaggttatgtggttgatcagccaattgaatttaatgaagcaattgtgcggttctatgatggtgaagaacttgctgtgatccataagactactgggaagagatacaatgtgaatgttaaaatgaaaaagcttcctgatgggtttacgctgcaaacaatgaacatgtggtcttggagtgaggttatttgattattcaaactcctttgtaaatggtataattgaattaataaaggagtggtattatgtccatcaattctattggaggctgagtcatgggagttagagtgggaggctaataagataaacattttgagttgctatttaagcggctcttcttttatgaggtattctaaaaaatatcgtcgataaaggagaaactgatgaatttcttaacagcaaaaaacgagtacggtgaaacggtttactttaaaactcttaatagaaggcctcgattgggtgattttgtgaaaccaatcgatacacgacctgtagacattgatggcaatagaattaaagaaagtggcaatagcgcaaataaatatgatgatctagatatcaactctttttatgaagtatacaggatatttaatgttaagcatgtaatcattaaagataaactcggtcataaagttcaattagattcaagtcaataccaattagcaaagaaaatcactaaagaggaatatacgaattttaatgaaaaacttcatttattaaaacatattgataacaaccttaaaaggattagcaacttttccagctaaataaaagcactttgtcgagctgcagatagtagctcaactctttttaaaacttttgagaataaaaataaaatagttattgaccgatccgttttggtgatgtaagattaagttatcccaaagagagaaaggaggaaagagatgaaaaaggaattaaagatactgaaagtatctgtcgaagccttacatacctacaaaaatgatgtcaaaaggaattacgacattgacgaagaccaagcaagaagaaagttaaccaggaatgtgatgttggtaaaggaatttaaaccaagaggaattaaaagaggtcttttttctaaaacatactcatatggaaacttaaagatcacaattcgacatggaacagtaataaggattgaaaatgtaaaaggtgatcctgaaccttgggactttccaaaaaagagatacatagaattaaacaagctacttggtatcaaggattgtaagtttagtagcaagtctcattataggcattttaagaataaaaataaaatataatattaacggaggcgttatattgagcaaactttataatacatttgaatttatcggtaacctatttatttcaaacaataaagagaaattccatgaaattaaggaatatgacagcggatgggttaaggaaagattaagcttcgcagttcaagagtcaaaaacaaacagtgtttttgttgagattgaaggtggttactcaaaaagcaaacaaaataaagtgttttcattcagcaagggtacagaaaatgaaaaaggatcaagactcgaaattccatgggaagatcggttgaaagaagaaacagtaaacatggttgctgatttttctaagatcctaattaacttaaacgatgagtcaacaaaaaccaaattaaatgaattgaagtttaaaattagagggttggaaatgaaagactctcttactgaagaagaaaataaaactttatctactctcaagggagaatataaacaattaaacataaacggtgcagaattcattcatgaatacgatgctattcagtacttatcccaaaatctcgaaaagcataaagacaataaatttaaaattacaggtaatattgaatacaattcatggaatggacggaattttagaaagttcaaaatcaaaaccattgaaattgtaagtagtgatacaccatctcaactaagagccacaatggatgtatttttcacaagtgaatctttagatgaatcgtcatttgaagaagaaaaaaggtactttgttgatgcatatgtgcttagctatgataatcaggcaaaaaaagatcgattttttcctcagcaattagtcattaatgcacaaaaattggactttgaaaatgatttacatatgaaacgattaaatctcttgaaaaacttctttaaagttgaaaatgatgaagtatatcaccttcaatgggttgtgaatattttcaggggtgctgatgagattgagtttaccgaagaggaactcacggaaagtcaaaaggaaatgattgctttaggtttaaacacactagatgactttaaacctaaaggagggctattgggcgaaaatcgtgaagaaaatagacttttaaaacctattttaaaaaagattaatgattctaatgattttacagaaggtgctgcaacatctacatatgaaattgaagatcttacatatattccacaacagattcaaaattctacaccacccgtagaaaaagaagaacctaaagtgactgaagaagaaaaagataatgcatttgatgatttatttgcttgatttgaaaagacctaactgacatttatttaaaaacaataaggagatgtttatccatatggcaagaaaatttggtaaaaagaataaaattaaagttaatcctctcgattataacactggaattattggtgaatcggggatcggtaaaacaactttagctaaagaagtttgcgaagaattagtcggagcagatgggtatataatcttgaatattggtaaagaggatggcatcgatgccatcccaaatgcctcctatgaagatgttcctgattggacaacctttaatgaaattactaaagatattattaaaaacagaacaacagattatgcagatttaaaggttttagtatatgacacatttgatgagttaattaaaattacagaaccagaagttattcgactacataataaagctaatcctgaaaaaagagtgaatacaattaaagcagcgtttggtggtttccaggcaggagaagacaaagttattgagttaattcttgagaagatgtgggaacttaaaaaggtcggtattagcatgtttattttaggtcatacgaagaaaagaacaatgacagacgtagttacgggtttggaatacgacatgctgacaaccaatatgacacataaatacttcaatgcgattaaaaccaagctgcacgttttaggagtagcatctattaatcggtcgattgaaaagaaaacagtaaaacaaaaaattgggcctgacaaaacagtgggaacagttgttgatgaatcaagaatcatcacttttagagatgacaactttaatattgattcaaagtcaagattctccgatatcacaccatcaattccattagatccgaatgaatttattaaagcaattgaacaagctatccatgtggcttttgataaacaaaaaaataatacaaataacattgaagaagaaagaaaagaacaagagcaaattaaagaaattcaaattcacaacgaagttaacaactcatcttttattgataaagaagagaatgagaggttggccgaagagattaagacactattccctaatgcaactgccgaagctaagggtgaaatgaagaaaattatggatcaatttaatatgaaagattttaaaggtgtagacattgtaccaactacagcattcgagaagatagtcgaagcattatctaactgaaggaaaagaggggggagtctcccccttatcaataggagagggtattcttggccagaagatgtgtatgtcaaatatgtaaagctaatggaactgttgatacttttttcagggtttctgatgataaggggaaaaataaatactactgtactaaggatgaatatgaaacctatatcaatgataaggtgaaacgaaaaaacctcttaaactacatagcgaaagatgtcttgaattatagagagggtcaagtcattcctccaatttttctaaaaaagatagctgaactaaaaagattttatgattatgaagtgatacaaatttgctttgagaagaaccaacaaacaattcaatattggttaactaataaagagttttacaacgagtatgggatgattagctatatttttaagattgttgaaagtaacatcaatgatgtttataaggaatggctgcatgaacaaaatcagagaatgattgaaaaaaatcataatcttgatattgcaattgtaaatcaaactaatatcgttgattccacatctttaaaacaaaacaattcaccaaaaaatataacagagtttctggatggggaggacgagtattgaacaacttagattcttatccaaaggaattagttgaaaacaggggacaaattgaaggaagctttatattttgtttatggaaaaaccctgatttgtatgaggattataaagaccacgtgagggcggatagagattttctaacagaagacgggaaattttattactctctaggtttagaactgagcaacatgaattataagagctttgatgatgcgagtgttttcagctacatagaaggtaaagaaacattaaaaaatggttttattcggcgaggtggaatgaaaaccattgatgaactcaagcacgtactaaacgatgaaaatgttgagacatactatgatgaactaattaaatttaacatgatactaaagcttcatgataagggattcaatgtttcgaacgagcttgataaattcaagaagatgacgagtcaacaattgtacagttactttgaatttcaattagataatgtttttctaggtcgcggttcaggagtgaaaattgaggatcttgatttgaatgaagagtttgtcgaatcaattgaaaacggggaagaaatgggattaagctattcagctgcatgtccattattgaattatcacacgcttggacttcataaatctaatgttcaaatttttgctggatttagtgggacagggaaaacaagtttttgtgtttcttcttatatcatgtcaattttagatcagggtgaaaaggtaacaattatcgccaatgaaatgaataaaagggcttggcaacatatttttatggcaacaattttaagtcataaacttggttattatggtttgccaagaaagaaacaaaaaatgggcaacctaaagcatgagcaaaaggaaatgttacaaaaggcaattgaatattatgagaagcattacaaggggcgtatcaaatttgccaagatatatgattacagcattaatgatgtaaagagaataatgagaagaatggcaaaacaaggcttcggttatatgctttacgatacatttaaagctgaagatgcggcttcaaccaatgtaacaggtgagctaattgaagcctcaaaacagttattgcaagttgcggaaaaagaggatatttgcatcatcattacaatgcagttggccatttatatggagaatacgagatatctaacagcgtcttgtttatcaaatgccaaagcagttaaggagattgtttcagagttagttctaacaagacctttatgggaggatgaattcccaggaggaaaattcgatgttaaaccctatagattcaaaaaagactcgtcgggaaaatttacaaacattaaagaagaaattcagttagacccaaataagaagtatagattattctttttgaataagacacggaatgacgaaggcgatacagtgttgttataccaatttgacggtgcatggaataaatggaatgagctcggttattgtactcctaaacatcagagaactacagagcggacatgattaccaagggacggtgaaatcatggacgtatatgatcttaagaatcacattattgaaaagccagagtacatagtacttattttagaacagacggggttttacaatgttgatgaacgcgggaatgagtacagatgtgcgagaaaaaaaggaagaaatccgacttcagtaaaagtaaataaaaccactttaggtgcaacctgtttttcaaccaacttaaaaggtgacttgataacacttgttcaaaataaattgggtttatcttttcccaaaacaatcaaaaggatatctgaaatagttgattataaaagtgaagaagaatataaaccacctgagttaccattcggaggtttttataagaatataagaagactaagtaatccaatggatttggatctagaaacgtattccgatgacattttagatcaatttgtatctgttccaaataagttgttttatgaggatggaatattacctttaactcaatctttgttccaggttggttacgatagtgtttccggaagaataacggtgccatggaaatctcttagtggtgaattgtgtggtgtaatggggcgtcttaataagaaggaagttaatgatgaggaaacaaaatggctgcctattatttcatttcccaagtccaaaacgctatacgggtttgttgaaaattacagttcaattagagaaaagagcattgttatgatcggggaatccgaaaaacattcaatggccttagcaagtaagggattgaatgttggagtttctttaggaggcagctttttaagtgaaattcaagcaaatcacataaaatcaatgtttccgaaaaagtcattagtcatgatggatgaaggattaggtgaagaacatagcgtagaaattgccaacagcctaaagtttgaaaatttctttgaaaatgaagttgggtacatatttgatcgtgaaaacaagtatctgcctaagggatcaaaaatggcaccagcagaccttgataaaagcactctacaccgtctaatcagagactgtacagtttggatatgaaaaggagatgattgattgaaagaaacattaaatgaattgagacaacaagggaaaaacatttattccttttcaaagcttggaacctttaataactgtgaatatgaatactacaatacatacgttttgaaaaagaaaggcatagataatatttacacccttatgggttctgaattacataacggaattgaacagatttataaaaatgaattagacattggtgaatttaaaaagggatttgaaaatagattaattgaattagagctgaatggagtcaactttccgagtgactcaatcggagacagctggaaagcagacattggtcatttcctaaacaattttaataaaattgacagcaaaatggttttagagaagctgcttgtatttgaaatatcagatgggatttatcttcaaggatatgtagatgcaatccttcccagtgaaaaaggaaaaccatacgttagtatttatgactggaagacatcaagtaagtttgccggcaagaaattaaatgaagcaggaagacagctattgatgtacaagcttgcattggagcaaacaactgacttaaaagtagataaaatactatggttcatggtgaaatacgtttatgtatgtacccaaggaaaaaccaaagtgaaaaagaaaatgtgtaacagaggtaagtgggtaaaggaaatacgaatgaaactagaaaaagagatgcgcactttggagtatgatgatttcgaaattgacctattgttagataacgcagtaaaagaaaatagcattgactgcttacctgccgagattagaaataagtattggcttgaagattgtttagttgaatacgaagttactgaagagaaaattaatgaactgaaagattatattactggtactgttaaaaagattgaaaataaagaccgtgaagatgaaacccaatgggaaccagtgaaaatagataaatacaattccttttattgcagtgtcttatgtggtcaccgaaaaacatgcaagttttataaggattttttaaataaatcatcaaataaatttaagaaaaaggataagaccgatttgtttgataacctattttcttagggggtaatgatgaggaagatattctatgactttgaagtttttaaacataactggatggttgtgctgatcgattatgatactaaaaagggtaaggttattgtagatgatgttgatgaactgaaacgattctataagatgtttaaagatgatatttggattggttacaactctagaatgtacgaccaatacattttaaagggaatcctgttaggaatgaatccttattatattagttcaagaattattaatgataatgtaaagggatttaatgttgttagagaaggttataagatcccactgaataactttgacataacaactggtttccacagcttaaagcagctagaaggctttatgggttcaaggattaaggagtcatcagtaccatttgatatcgcaagagcattaacagaaaaagaaattaaggaagttgttgagtactgtattcacgatgtgaaacaaacaattgaagtgtttgataataaaaaagaggaattcgaaagtcaattggctttaattgaagcctttgatttagaaatgtctatgtttacaaagacaaaagcccaattatctgcatttatcttgggggctgaaaagcaaggaaacaggggagatgagtttgaacttagatttcctaatacattaaaaattgaaaaatacaaacacattgttgattggtatagaaatcctgaaaatctagattataaaaaaaacttaaaggttgatgttgcaggtgtacctcatatttttgcctggggaggtttacatggggcattaccaaagtataaagatgaagggataattttatgttgtgatgttgcatctctatatccttcaatcatgattgaatatgattacatcagtcgtaacgtgaaaaaccctttgaaatatactgaaatcagagatacacggttagaattaaaacgcaaaaaagatcctaagcaggctccctacaagatcgtcctaaactcaacgtatggagcaatgaaagatcagtataatccactttatgacccgttaatggccaataacgtatgtttagccgggcagctgttgttattagatttgatcgagaaaattgaaccgtattgtaaactgattcagtcaaatactgatgggttgtttatgaaagttgagaaagaatctgatattgatttaattaaggaagtggcgaaggagtgggaaaccagaacacgattagatttagagtgggatgtttatgagaagatttatcagaaggatgtaaacaactatataatcattgataaagaccagaagtataaatctaaaggtgcttatgttaaaaaactaaacaacctggattatgacttaccaattgttaataaagctatgattgagtattttacaaaagatattccagttgaaaaaaccatcaatgaatgtgatcagttaagagaatttcaaaagatatcaaaggtttcaaacaaatatatgtacgctctctatggagaagaaaggctacctgaaaaagttttaagagtttttgcttctaatgatgaagatgctaaaggtgttttcaaggttaaaacagaagaacgaattgaaaaaatcggaaatactccaccgcgctgctttataaataatgataacgttattgatttaaaagttcctgattatcttgataaggaatattacatagagatagccaaaaaacgaataaatgattatttaggaatatcgaatagaaagaaaacaaagaaggagaagtgatatgcatcgccattaagagtaaaaataaaattaaaacacacattttcaagtctgtttatggtatgatgattttgattcccttaaccactttttcttacataagttatgagcaacatttacataaaacagagggaaatgaagactcaataaaagaatcattttataagaagcctagacagattaggataccatcaagtgagaatattgtcttacggctatttaaaaaagctcaaactaacaaagaacagcaattaaaaaggcatacagagaagattatctcagcaaaactcattaaacctaagcaaagtaaaaaaaggcacaggaagggaggtgagacggtaaagcataaactttttaagagtaaaaataaaattagtattaaagaaaaagaaaacaagccaccggccgcaaagaaaaccatccaggttaagctgagtgcttatattgcccactgccaagaaggatgcacaggaacaactagaacaggtgttgatgtcactcaatcaatctattacaaagggtatcgtgttattgcaaccgaccctagtgttattcccttgaattcaatagttgaagtaagcattggtgggaaaaagttcaaagcaattgcaattgatactggaggagcaattgttggaaataaagtggacttgcttgtagcaaccgagcgtgacgcaattaattttggcaagcaaaaggggacaatctcaattattagttaggaggcgattaattgccgaagttttggtcttatccagaagggttaaaagtcatcataaatgagaatgcaaagaacgcttgtcctcatcatgttggacgggaagggaaaattattgagctgctacactctgccacatatgattacgcagtcagtgatgaaacaggtgatattacattcttcaaggagcatgaattaaatccagctaaaggaggttgattgtatgtttaaaaagggagagaaggtgattgctggtttcacaggagagattggtgttgttgcacaagttgataaaggacatgagcaattagaagttgagtatccagacggctcatatagagtgattggcttcagcaatgtaagaagggtggaagataaatgacgatgattattttagaaggcactgactgctgctacaaatcaacagtagcagataagctaagcaaagaactcggatatccggtaataaaaggatccagctttgaattagctaagagcggtaatgagaagctgtttgaacactttagcaagctggctgatgaggacaatgtaattattgaccgatacatatattcaaatttagtttatgcgaagaagttcaaggattactcaatcttaacggaagagcaacaaagggtcatcgaggagaagattagggataaagccaaggtgatctacttacatgctgatccgaaagttattaagcagcgtttacttgaacgtggtgacgaatacataaatgatcgtgatattgagccggtattaggattatacagagaagtaatgagcgatgttgggttacatacatattcatgggatacagaacagtggtctagcgaagaaattgctaaaggcataatctttttaacggatggggtgatttatgaagaaagtaattgcaattgacatggatcaagttttagccgatttactaagtgattgggtagcctacattaacacctatgatgatccttttctaaaagaggaagatatactgtgctgggatattagcaaatattcaaatacccaaaacaatgtttacaggcatttggattacgaattattcagaaatctggatgttatagaaggaagtcagagagcagttaaggagctggcgaagaaatatgaagtatatgttgttactacagcaacaaaccatccagaatcccttaaagcaaagttagaatggctcacagagcattttccatatattccacatagtaatgttgtgctttgtggcaataaaaacataattaaagcagacatcatgattgatgacggagtgcataacttagaaacatttgatggaatgaagatactatttgatgcaccgcataacaggaatgacaatagatttattcgtgttatgaattgggaggagattgaacggaaattactttaaaatatcattatatttagagtgaaaataaagttaaaaggagtgaattaacactccttagtaaactaacgtgcttctactgtaattttataaatcacataattgtcgttaatgtcatacgcgtaaaccaatgctgtgcccaaagttgaatgagaggatacgacaccactggaactaatgcttataaggttgcttccagatacaatttcccatcgggtgtagccttttaatagagatacgttagaattcctcagcatgtgaaaatcaactgtaccaagcggatcacctagctgcttaacttgatcaattgatttgacaggggttaaagcagaagcctgtgatgtgaatgcagggagtgctagtgctgtaagcaatagagcagaaacaatcaatcctttgtaaaactttttcataagaattacctcctaggttttgattgtgattacatctccagtctagcatgttaaatatttgaaatgtgtgaagtgtttgtgaaactgtttaaaatatctcttttaaagagaaaggggagactgtaatgggttatagacattatatgtataaaatcagcaaggaacttgtaaacgaaataaaatcaatgaattacaatgaattgtccaaaaagttcggtgcaataggagaagaaggttatttctatataggtaacctgcctaaagaggaaatttgggagtttgggaagttgtattgggatgatacagccgaccgcatttattcaaagggacaccctctctttgaaagagaagaagttatgaatgaattatcggattatgttccatatattgttggtaaagaagggcttgaagaagctattgaaatttataaaaacaaagtcattgcaatgtacgagaacttgcttattgatgataaaaatggaactgcttcagtaaaacaagagcagcatattaagaacaacttatctgagtggactagaggatgggcgttaaatacggatattaatgattcatggctaacatcttcttggaaatatgaatacagtatttttgagctggtcagattattaaaaaccatagattttgagaaagagacaatattattttacggttggtgatctaaataaaagatcaattttatcgaaatgagggtgtgaaatggaagttagatggttagttatttttaatgattgtaaaaccggcagttctttgagtgagcttacatatagtaaggatggggaaggaaaccacctaagattagagtcaatggtgcctcgtacaggtgactatattgtaggaggagatctgtcatcagatataaatgataagaggtgctttattgtgaaaaatgtcttctggaatctagataggagagatatagaggtttatctagatgaggttgacaggactgtttttcctttatataaatcgctataaaatttgtcttttaaagagtaaaaataaaatataagaggtggagtctgtagtgaactacccagaaagcttaaaagaggaagccgaaaaaattaaagatgaagtaagaagcggcaaattagacgaggggaaaataaaagccattgctaagtctgcagttgagtttttaagatctcaagaaaagagtcatgctcattgtgcagaagttgctggagcgattgctgcaaacctagatgagttcttcaagtcttatctaaaagaagattaatacaacaagataacaagaaaggataaagggatgtttattgaaaaggtactatgttagatgtaaagatcacaaaggcgaaaacgcgtctttggtaattgaagcaatgtctacagaagaggctaaacggaaggcattagacatacataaggtaaagactgtttataacgtgagcattggggaaggtagggggacaaattgccttcagagaaaacattcgccgtacataaagaatgacaacgggaaagctataatcatattctcgtagaggaggtatcggataattagggatactgccagggatatcattaataatgacgttgatgagattgaggaaatattagataagctttgggtttatttagagaacaatttaaggccagaggataaccgtatatggaagaggtgtgattcggatattttggcagcaacagtaaagctaagaaatttaaaagaaactttttaagaataaaaataaaatagttgttgattgtttgagagaatgcgagtatattagaaatataagaatcgaggtgatgcattggagtgtgttaaatgcaaggatcacattggcgaaatcgtttattacataagaatagctgacaacaaagaatataaggaattcgcggtacataaagaatgcggagaagcaatcaagaaagaatgcattgaaaattgtaaagacatgaaattagaaaagacattggattacttgcagttactttaagagtaaaaataaaatattccttttatcgagaatggagagatgctaaatggataaattgaaagtttgtttacataaaaaaggtgctcatacgttagaaagaactgttaatggaggctggatattagattcaaaaccaattactcaggatcaagcaattaatgaactagttgaagcggttagtgatttaggatattggtgccaagtagcaaaggatgttttagataatgaagactttaatgcagttcaagaggcgtatgaataccatgagtaataatctagtccattataagaagggagaatgaaatgtcatatttggtgctgggactaatcttgttcggttcaatattcataggtaatggacttacaagtttagttgagaataaaaactttaaagaagccttgccattttatctcactgttttcttaatgggagcttgctcgctccttatcggatttattcttacagtgatatgaacaagatgaagggaaatagtgaaaggaaatataaatgatttcctgggaaagcgcagtatgcgacaaattggaacaaatgatgtctttaggtgataaacaaaaaaggagcatagagccatggaaacattagatgcaccaatttatgagattaagcaagaaagcaattggtataaaactgagaagaaacgaagagaagatattaacaaattctttgatgaattcgaagcaacatacggaattaagaatggtttttcgttctatcattccgagtatttcggagtacgcgcaggaacagaagcatatgacttctttaaagatgaagtggtgaaaaaccccacaaaagctggcttctatgcatttaaaaaacgttctaagtatttcacagacataaggtctatgctagagaaaatagaagaggcaaatcctttcaaaggccatgatgtgttcgggagaaataatataactgcaagccagtgggtaggtgatagatggttttttggcgtaagagatgagaaacgtgtagaaggtgaagaagctgtagctattgacttcaaagattatcttaaaattatcttggagaaattaggttaaaattcaatttttataaagaaaggagaaaaacatgagagacattacatccgaattcacattgagaggagtaaacagaaaaactctgaaactcctggcaactaagagtattgattatccagatacatgggtaaaggttcaaattggagatcaaatagcagaagttgaggcaaagcaactgttggtggcaataacggcatttaatgaaatgtgagaaggaagaaactaacatggagaagtgtagagcagtatttaaaggcaagaaaatagaaaagatttaccttttcagggcatatccatcgtgttttcatggcgtccatgcgaaacgaaagccaccagctattgaccacgagtatttagatatatctactgaaactttttatgaggatgaaattaattttgaagttaactgtggtgacactctttacataaatgaacttgatgaaaatgttcatatagaaaaaaaggtcaaaatgcttgatgggggatggatttacttcactgattatgtcattagcacagtcgagaataaggagagtaaaattcaagctgaaaaacaattaagggagtatttagacgaaagtaaagtaaaagaaaagcatgataatcagctaggaaataaaaggatatcattttggcaacatttgaaacatgcttttaagaaagagatgcaacagtaggaggtgaataagtgggacgacataaagcaacatttgaagggaaggtaattaagaaaagttggacattaggcttgtgtgatgcccttgtcccaatcgagcagcaatgtgagtatcagacattttttgaagggaacatcgacttagacccaattgaagtcggagggaaagtgtatatcccagggtttaacgaatacgtagtcgtaacagacaggcaacgcaacacaaaaaatgaatggacatatcagactgacaaggtcattaaaacaattgaggataaagagagccttgaaaaagcaattcaaaaacaagaaaaaatagagaaatggaatcagcaagttaaacaagactatgaacgctttaaagagcaagaaaagaaacgtaaaacttcctggtggaagaggctaatcactaaaaaagactaaaggagagatatttattgaataaggatacaaaagatatttggaacggtttctttatcggatcaggttctctgattgtagtggggttactcatttttgttgaagcagtgactatgtcactagttgtctattatggattgaatcatgtgttaaacccattgcttattgatacatacaacattcaaaatacccatatcactttacctcatgcatttgtgattggtgttttactcaacgtatttgtcaaaggtgtaaaacggtcagatcaggaaaaagatgagaacattttcaagaaagccggtaagtctttacttcattcagcttttgcattgattgttctgtatgtcagtacattgtttatttaacgaaggaggaatctgaatatgattaaatcgcagcaagttaaagtttttagagagacgttacattgtgatgaatgcgaagaagctccagagcttgtgttttcaaatatgatgctcacatcaaacccaccgaaatatccgtttcaatgcccattgtgcatgaaaaaagtttatatgaaaacaacctatccaaaggttagataccaatcagttgattgaagtctaaatgaaagttttattttattgaaaggatgaagaagaatgaaaatgagaaatgtaaaactgtacaaaacgactgaaaacgtttttcttccaaatgaaaaaacattggtagggacttttgatgattgtgaaatgtatgaaggagaaaggagtgtattcttagagattgcaaataaagatgatcttaaaccaagtgactctagtattcatatagaagatcctacgattttagaaatcacaacttgtcaaggcaaaacaaagactattaggacaaggaaaaggttaactgacatttcttctgatttaattaaaattgaattcacagttctgtaggtcgtaataaaaggatgattttagagagaaaaggaggaatagctatggcttatgatgagatcaatgggaaattaattaatcctaaagttagcgatgtaattaaagcgctacaagaccaacttgattttaacggagatacaccaattcaattcagaattgatggtgaagaaacaagcaatgaaattcaattagatccatataaaaatgttcttgtgtttcatttagatgaagtttaaggaggaaagctacaatagacacatttgttttatcggttgtcaggatagacattataaaggcggtttatatatggttattggagaagcagttcacactgaaacagaagaaaagttggttacatatgaaggccaagacggtgttctttggaaaagtgattattgatgggaaagagatcaagagattcacaaaagtaaaataaaaggagaattggctatggggattaaagcagcagtttttgaaataaaagcaacttgttacgctcatgagggatttaataacgaaagtgaatctgttcaaggggctgcgttagaacagctaggaaaggatatcgtagataatttactcgaaaacggtgttgatgatgtaaaaatcaaaggcgattacgttgaggaattgggagttgagaagcccgttatgaagtacttcgaagtgagcgatccctattatgcgttaattaaagcttactcaaaagaaaaggcaatgaagttatatacaaaagaagttgctgatgatgacggggaattaagtgatgagatgactgaagttggacaagtttatgcggcaatacgacaaggaagggttccgggagaaggtgaagagcttatgccatttaagcaggttcttgaagagatttctaatgatgaagaaatggtattactaatcgagggcagtttactttaacggataaaaatacaaggaggtgaattcatctgggaataagtcaaagacagggcaaatatatcatggaatcgattaatgaaacaaattcaattgcagaaataattggtcatgataaagctatcagtgaagtgttgcttctattaagggaaagagtgttgtttcttcaaagtcgatatgattttgaagaagtggaaataagattaaatgagctcatgaagctgtatgaaagtatcaataaacttcaaagaccacgaaaggatgatgaaaatgaataaaaaatacggactttattgcatgggaacacttgttaacacttatgatgacgctattgaggctcataatgatgctgtgtatgctcaagaagaaagtggagtgccgcatgaagtaagagaaatcagaaaaggagagtagataggatggaatacactaagtatggaaatcttgtagaaggctatataacattcaatctttattttgagacatttgaatacaaagaagatagcttattagaacaagtaaaattcaccacagttaaagagttattcaacatgatgcagccagactatgttgaagaactaaagcaagaaaacggtgcagatcaggttgacgttcatgatatcacgtttagcgctaaagaagatgacactgaggctttcatcacaatgtatgacaactcaggaaactatcgaatctcaacaaatcttgatgtaagtggcttggatagcgagtacaagcaaacattaaaaagcattaaaggtattatagataagaaactttgagagtaaagtaaaggatgatgaaaatgaatattagagagtttattgctgagcagagaaaagacgaaaagttcttgggtttgagatcaaaattaagggaactaattgaacacagaagacttgaacttgttgaaatgcttggatataaaatcgatagtttgaatcaagagcaacttatagaattcaaagaaaaattcagtgaattaactgcatttaaagaaaaggtaggtaatgatcctttcagcattagtctggatgaacttggcgaacttctatgtttccaaaaaaaataaggaaggtagatacaaaactctggagtatgttttgagtaaaacgattgatccatacattgataaaccaaaacaggctacagttatttctagataaaatcacagtttcaaaggaaggggaagcaaaatgagtgcagcaagaaagtggagagatttgagaagcaaattaattggatataaggtctacggtaagttcagcgatgttgttattgaccatattctaaatgatatggataagttagacgtaagacatgacaaagataaaaacaaaaaataaagaaaagggagttgtggaatgggagctgctaaacagttatacgttaagcgcagtcactttgtaaccttggatgaagcaaaagaaaatacgcaagtacatatgaagaatggtggttcatacactgctttaaaaggagagctgattgcgactaatcttgaaggggatcaaatggttatcacacaagagcagaaggataactacattccagtaccaatgacagagttatcagattatgaagctcaaatggccaaaggctatgctgaaatgggagacattaatttagaaatgtctgaagcttttcatcatgctgaaaatgaagcagaaacaaccaccaacagtttggttaacggagaatataaagaatattgattattacatatgaaagcaagacaggcaatgtgaaaaggtttgctcaagctttacaaagggagttaaacttcgatgtcattgaaattacagatgacttaatcattgaagaagaatttatacatattacatatacgataggctttggggaagtacctgaaaggactttaaactttattattaagaataaaaataaaataaaaggagttgttgtgagtggtaacaaggtttggggtgataactatggtttagctggggacaagctctcagcaatgttccacgtaccattgttattaaagtttgaactaagcggaacaaaacaagatttgcagaagattaatcgggaggtacaacttattgacaaacacaataccaaagtggattaagctcaataatgagatcatgattcagaaagacggtaagtttcaatttgagaaggataaggaggcagtacacagctactttgttgattacattaatcagaacacagtctttttccatgacttaaaagagaaactggattatctgactaaaaatgattattacgaagaagaattcttaagcgaatacacatttgagcagattaaatcgatttttaagattgcttacagttacaaattcagattcccttctttcatgagtgcctttaagttctacaatgactatgcattgaagacaaacgacaaaacaaagatattggagagatatgaggatcgtgtctcaattgtagctttatattgtgcagatggtgattatgaaaaggctattgaggaagtacacgccatgatgaaacaagagtatcagccggcaacgcctactttccttaatgcaggacgtaagcgaagaggtgaaatggtaagttgcttcctacttgaagtgggagacagtttgaatgacatctctcgtgcaattgacatttcaatgcagctgtctaaattaggcggtggtgtagcattaaacctaagcaaattacgagccaagggtgaagcgattaaagacgtagagaatgcaactaaaggtgtcgtaggtgttatgaagctattggataatgcttttagatatgcagatcagatgggacaaagacaagggtctggagcagcttatctaagcgtattccacccagacatcacagacgtccttgataccaaaaaaatctcagcagatgaagatgtccgagttaaaacactgtctattggtgtagttctccctgataaatttattgaattggcaagagaagataaggatttttacatgttctatcctcactcagtctacaaagaatatgggaagtatcttgatgagatggaaatcaataaaatgtatgatgagcttgttgaaaaccctaaagttagaaaagcaaagggaaatgctcgaaaactgttagagcaattggccattctaagaagcgaatcaggatatccgtatatcatgtttgctgacaatgtaaataaagtgcatccaaatgaacatatttcaaaagtgaagttttctaatttgtgcgttactggagaaacacttcttttaactgagaatggatatgaaaaagcagctgatctttacaaaaagcagaatgagcttaaagtggtcattgataatagaacaaaagattttgcagttggcagcaaaggtacttcaatagtagatgcaattccaatgcaattgactaaaaaagatgcggaaatatttaaagtcaaaacgaagcaaggatatgaaataaggacaactgagtggcacaaattctatgtgaaaagggacggtgaaattcaaaagctccaattgaatcagctaaaaacgggcgataaattattagttcaatcaggtgagggagcatacggcgacattcatgagccagatcttgcttacatcatgggcattatagctggggatggaaccattactgaaaaaactgccaagatttatttatacgataacaaaaaagttcttgagcagaaagttactgatgcagttcaccgtattattcaaaaacacaagctcgatcgtgcttataaacacaatacatcactggctccaacatttaatatggctaatccagaaaaacaagatttactctacatgaatagtacagtcttatttgacatcttgaagaagttcggtatggacaaagaaactaaaacaagagtcccagaattcatttttcaagctaataaggaaacgcaagcagcttatttatcaggtttattccagactgatgggtgtgtaaatgcaaatcataaagccaaagcattaacaattgagttaacatccattcactatgagagccttcaggacgttcagaagctattactaaacatgggtgtttatacaacgatctattctaacaataagcgttcacaagaactccttcctgacgggaaaggtggttctaagctgtacaatgtaaagccaactcacaaaatcagtattcaagatagaaactcaagagagttgtttatgagcattgttgaaatgaaagaatacgatatttataaattcaatttgctaactgagacattgcaaccttcttcaagaaagccaaagcatgattttacggctgaaattattagtattgaagaagatggtgttgaggatgtttatgatacaacacaagaagactatcactctctgattttcaatgggattgttactggcaactgttcagaggtgctccaagcatcacaagtctcagtttatacagattacgatcaggaagacgaaattggtttagatatctcatgtaatcttggatccatgaacattgtaaacgtaatgagcaatcaatcaattgcttccacggttagaatagcaattgactcactaacgactgttacaaggaaaacaaacattgtaaatgccccagctgttgcgagagcaaatacactaatgcgatcaattggtcttgggcagatgaatctacatggttttttagctcaaaataaaattgcttatgaaagtgaagaagctaaggactttgcaaatacatactttatgatggttaacttctactccctgcaacgttcaatggaaattgcaaaagaaacaggggagacgtactacaagtttcacggatcaacttacaaatcaggcgagtattttgataagtacgtgacaattgattatagccctaaatatgaaaaggttaaaagcctgtttggagatcaacatattcctaacattgaagattggatgaagcttaaagaggatgttatgaaatatgggttgtatcattcgtataggcaagctgttgcacctactggaagcatctcatatgttcaatcatctacagccggtgtaatgccgattatggagagaatcgaggaacgtacatacggaaacagtaagacatattatccaatgccaggtttatcggctcagaattggttcttttataaggaagcatacgacatggatatgtttaaggtagttgatcttattgccactattcagcagcacgtcgatcaagggatttcatttacgctgttcttgaaagatacgatgacaacgcgcgatctgaaccggattgatttatacgcgcatcatcgtggcattaaaacgttgtattatgcgcggacgaaagataccggccaggattcgtgcttgagttgcgtagtttaaacgaaggggaggcggagtcgtgaagttagaaatcggtcaagagtgggtcagtgaaaagcacccacatgaaaactttaggatctacggaggagtagtggatacttgtgcagactcatttaaggacgaaagcataacattcgatgagcagccggaatgggctaaaattttcttctgggagcgggcggattatgcgagtttcgataaatacgtcgaatcaaagctaggaaggaatcgagatagtacgtatcctttcgctagatgtggagagacgaagaagtccggattagtagcaaaaatcaaaaaattcaatatggtcgttaaagagaaggaggatgaataattgacgcaatatacagcagcaaactggtcaaagcatgaagatgatttcacccaaatgttttacaaccaaaacgtaaagcagttttggcttccggaagagatcgcattaaacggcgatcttcttacttggaagtatttgggtaaaaatgagcaggatacgtacatgaaggtgctcgccggcctgacactgcttgatacagagcaggggaacacgggcatgccgattgtggccgagcacgtcgagggccatcagcgaaaagcggttcttaatttcatggcgatgatggaaaacgcggtgcacgcaaaatcttacagcaacatctttcttacattagctccaacagagcagatcaacgaagtgtttgaatgggttaaaaacaataaatttcttcaaaagaaagcaagaacaattgtttcaatttatgaagcagttcagaaaaacgatgatatttccttattcaaagcaatggtagcgtccgtgtttttggagagtttcttgttttactcagggttttattatccactttacttttatggacaagggaagctcatgcagagcggggaaattgtaaatttaattatccgtgacgaggcgatacacggcgtttatgtcggattgttagctcaagagatatataagaaacaaactcttcagatgcaaaaagaattgtttgaatgggctttaagcttgttgcaggagctttatgaaaatgaattggagtatacagaagatgtttatgatcaggttggtttagctccagatgtaaagaaattcatcagatacaacgcaaataaagcattaaacaatctgggctttgatcattggtttgaagaagaggatgttaatccaatcgttattaatggattgagcacaaagactaaatcacatgacttcttttcaatgaaaggcgttggctataaaaaagcaacggttgaaccattaaaggattctgatttcattttcgatagcaaaggagttatttcatgagactgattaaattagaacaaccgaattgcaatccttgcaaaatggtatccaattatttaaacgaagcaggagtcgaatatgagacatttgatgtaacacagaagccagaagtggcagcgcaatttgaggtaatgagtgtaccggtgactatactgctgaatgagcaagaagaagtaaagcgtagtgttggatttaagcctgaagaacttgatgaactactaaagggattacaataaaagataatttccttaggggagggctaaccatattcggttggaatattaacgagatttcatggtggaagtacatactgcttttaatttttttaattactgtaatacctttgttgataatggattggataaccttctgtaagattaagcatattgactggattattcaacgatattcatgttgggcggcctatttaatttttggatagatttttcacataataaaacaaaaggagaatgttaaatggggaaaatggatgaagtaattgttgtagcacctagagataaagtatttgataatgaagaactagtctttcaaggaattgaatctgatctaggcaaggttgatcaaataatcgaaaatctcgctgaaagcatgatcactatgaataggggagatgctgagagggatcaaagctgtaagcaaccaattccctatgccattttacaaaaaggagaccgagtatttgcatacgagcggttaagaaaaagcggggaaaagaggcttcatgatcaattatcaattggtgttggcgggcacatgaatttaactgaagcaacaaatttttgggaagctattgatgagaacttaaggagagagctttcagaagaggtgtttatctcaacttccaatttaaatttagaagttgtggggttgataaacgatgacttaaatgaagtggggaaagttcatttaggcataatgattattgttaaactgcctgaaaatgcagaggtatctgtaagagaaacagatcaattaaaaggcttttggttaaataaacaagattttgataatccattagtatttaatcgtttagaatcttggtctaaatacgtggcagatattatttattagtttaaacccctggctttgatcatgatgtttgtcagtggagggtctcagccagggtacaacttaaaatactcaaaaaactcaacaattatgcctacaaaggagatgctggatgaaaaaaagattacgcaaaaaggcgtggatgacagggaatataaaacagggcgaattcatgtttaatgtaattgataaggtaaatgcagatggacatgtatattatccaaaaggacactatcatgtagacaggaaagggaatatgtacaagttcaaaatttagaaacaagcgaaattgtgatgactaaagttgataaagatcttagggataccaaagggtgtcgattgaacgaacatctctataaaagaagacttttatttaaaataaagaggaggaaacagaccataaacaataacagtcataaagatttgcaagcaaagtatgatgatatgctcttcagaaacggactttgtttggggtttattcaaaaacaagggcttgcagatgtgtttttggagcatatgaaacaagttgcagcttatgaagaagaccaaaggtatagagttgcagcagttaattttttgagtttattagaatcaaattaaaacaaaaaggagatttgaaaatgaaaatttcaattaaaacaaggctaaatcctactgatcaatataaggttgacgactttattaatgcatttaagaacttgccgccagaaataagaattcagctttctatggacaacgggaacagttggctgttagaacaagtgtcagtgaaaacagaaagaatccttcttgattgtttacaagaagaaattaaaaatattgataatcaccctctttattctcatgccacttcattagggcaaactgtattccacaatactcatgaaattgtcgatgttgtcaaagagtatgtgaagaaaaatggataaacatatagagaaaatacaagcccatctaaaagaaatagaaaattttaaacaaggcctccaattattcagtgaagatgaagaagaatacataagcttattagctaagattcaacatcagtttgatttaatttcagacgaatcaatggaagggtttaaagaattaactttacatataagaaatacaggtcagaaaagaatccaacggagaattgatcagttacctcacacaatcaaagaaagtgtaagtgaagaaattaaagacatgaagagagccggcgagctttttgattgatatttaaattttaaacatggctatataaacagtgacaagtatcgattgggtgtgaacttaaatacaatacattgaaaactgtgaagaactggaggttttaatgtgtttagacaatatccaatatggtacacaccgtcgctgcatactttgaattacttgccacaatttacaccatacattgcccactttaatagtgctgaacgatgttttcaacgatgtatgtaccaaacgcatggcaatgttgaatggtgccatagaaactgctacgacccgatctatcaataaatttaaccagagcagttggatttaattcctctgctctaaaaaataaaatagggggatgtattataattacatactttacgttaatacttgcagcatacttatttgcactaaacattaatgaaattagattaattactcgaggggaacagaacgtatacgctaaagtcacacatttgctttctaactcaccatataaagaactgaagaagaataagaacttagtgtatgtcatgacattgttcaaggggatttcgttcattatccccttggctactattggactgattacgcatggtaacttgctaatgttagcttgaacagcttttgctttaatatataccggtttaacaatgtttaaaattcttgatgttttggacggtgactcaaacaataaacaaaacaagttcgtgtacatgctttttgtttgcggtaatattgtcttcgtggttaactttattatcagttggtttagataaaggagaatagaattatgactcagtttgatatgcagtacaacacaatcataaatgacataattaataatggggcatctgacgaagaattcgatgtcagaaccaagtgggatacagatggaacaccagcacatacattaagtgtaatcagtaagcaaatgcgctttgataattccgaagtaccgattttaacgactaaaaaagttgcttggaaaacggcaatcagagaattactttggatatggcagcttaaatcaaatgatgttgacgaattaaacaagatgggcgtacatatctgggatcaatggaaacaagaagacggtacaatcggcaaagcatatggatatcagcttggtaagaagaacagaatgctaaacggtgaaaaggttgaccaggttgattatcttcttcatcagttgaaaaataatccatcatcacgcagacatattacaacgctttggaatcctgatgaattagactcaatggcattgactccctgtgtctatggtactcaatggcttgtaaaaggcgggaagttgcatttagaagttttctgtcgcagtaatgatctcgcactcgggaatccgtttaatgtgttccagtacaatgtattgcagcgtatgattgctcaagttactggctatgagctaggtgagtatatcttcaatatcggagactgtcatgtatatactcgtcatatagacaatttaaagattcaaatggacagagagcagtatgaagcacctgagttatggattaatccagatgtaaaagatttttatgatttcacaattgatgatttcaaattggttaattataagcatggagacaagctttactttgaggtagcagtataatgctatctcttattgcttgctgcgataaatcaatggccattgggtatgaaaataatttgctttaccatattcctgaagacatgaaacgttttaaagaactcactacaggaaagttgtgtattcaggggagacttacatacgcttcaatcgtaaacattacaagaaagccacttcagaaccgaaagaatatcatattgactaaaaataaggatttcaagcctgatcactcttcatttgtttatcattcgattgatgatgtattaaagcttataagaggacaattggataaagatgaagaagtaatggtaattggaggaggtgctatatacgaggcattcttaccacatgctgataaggtttatttgacgattgttgattcagttgctgagaaggcagattcatattttcccaggttaaatgatgactggagagtaattgaaaaggatcacaggaaagcagacaacaataccacatttaattattcatttgtgacttactcaaaataattttagaataaaaataaaatagttatagactttttagaagttgaatgataagataaagacaagttaaaagcttgtcttttttttacatacttttagaataaaaataaaataataaataggagtggcgatatgaaaactgcaacagattatcttgtttccatttccaaacctcttgttgcaattgaggagactaaacaacgacttcaaaatgaaattgataacctttataaagagctagggaaagttgataaagagctcaatgaattttatcacaagctagaagaggacaaatttaatgcttcagagggatatcacctttcgttgaaaggtcaaaagatattgagaaagcgaagaagcttaaaacaagagctccaattactgaacacgcttttcggaagtttaaacaataatggatggactcttgaatcactgaagattgcagaatataaaattagcaaaaagaaaaacaagcatttacagtatgaatcggtttaaaaacaagcctacataattaaataaaaaagagagggaagccctctcaatgtattagtaattataatcccaataaacatcaacattaacttttacttgagctacactgtcattgttatgtgctcggacatacaattgttttcctgaaataagtgatgtgtttacgctaaatactttgtaaaattgttcactaatataatttccgccactcggtgtaacagaagccagcacagtgccatctgacttcattaattcataagtcacatttgcacttctacttcctgtccctgttgaccattgtttccccatgatggaaatcttggttacgttgtttggtgtaaagctagtgactactgttgcgtaagatgcagggcctgaagtagatctacctatgttgacttcaccaacaccatttttaacgtgagtatcagtcccaagagcatgaaaactaccggtgtttgttaagacctcaagattattttgaggggcggcaaccggctcacttttagcagtagcattcgctgacgcagctacaccagtaagaccaatagttgaaactaataaagcaattgctgttttcttcattaaaagcatctcccttggtttaggtatgtaatacaactatattataacaattaattttgaaataaatggagaatgttgtgaatatatggtgaattttctgaatggagtgtgaatttcttcggtgagaactttaaggaggtgatatattgcaacaaaaagagcaagaattgctgtcaaagaaagaacagcttgaaattgatgttttagaaaaggaagcagctttactccggctagaagtggaacaagaagattccaatctccacaaaattggggagatcggtgtacttaaagaatttcttttatacataaagaaatacagatcaatgtttactgtgcagcaagcagaagaatttagaaatatggatgaccgaatgaaagaaatcatcaaagtccaggttggacaagtaatggttgatgaagaagctttagagggatttattgaggaaattgagaatcaaattaattgaaagtgggagatgaggaatgaatgaaaaattaacgaaagatcaactcgaagaaatccgtcaacgtatggaagcgacaaccaaaggattttggcatgcaaacattcaccatgaatggccagggaacgaaaatcttcgttattggatagttactcttgaggatggtttagcagctgcagtaactaaagaagacgcggacttcatcgcaaacgctcggcaagacattcctaggcttctcgattatataactgagcttgaaaggaaacttcagaaaaaagaatatgaacttacagagtgtaatcgtgtctatttagagctgttgagtaaacaagagttcaaaacaactgaaatctaagtaaaatctgtattttaaagagaaggtgatgcagtgaaagagtcgttgaagaatgattttcaagagtttatgagtattgcaaaaagctttcttgctgtttctggagcagtcttttggttattgataatttcactcgtttttgctgggggctattaaaatgaatcaatcatataaagttagtctagaaaaattaccaattgaaagcttagagagactgaaaacagacatacaaaatagaattaatgatggattgcgtaccgataacaatgcatacataaaagaccaaagaagaaaacttcaaatcgttttaaacgagctggttagacgaagtacatttgttcactaaaggaggtgaatacaatgccagtagtactttatggatttggaagaggagcataaaaagagaggggagtaatcccctcatacattaatgaaattggccattcatgctttgttgggctaggcgaactaaacgttttgtgatttctccacctactgaaccgtttgctcggctagttgtctcaggccctaagttcacaccgaactcagaagcaatttcatacttcatttgttcaagggcaccagcagcttgaggcacaagtaattcattgctgttgtttgatctgttttgttgagccatatgatcatctcctaaagttgtatgtaaacaagcttgttcaattgtattgtgtggagatgttttgtaaatatacacattaatttaaagtgaggggatttaaatgtcaattggtcatggagcatgaattaacacgtacttaaacaaagaagggggataaaatgaaaatcgattatgtttcagatctgcatattaatcactggataccttgggacaatgaccaaattaaatgggaaaggcgaacaagggagattattagaaggctgatatcgaatggaaatggagaggtattaatcattgccggtgattttactgagtggaatcaacagacactgtgggtacttgatgaagtagcaaagcagtatgaaaaggtttacttcacatatggtaatcatgatctttatttactcagtaaaaatcagcaacgaaaatattccgattcattgggaagggtgaatgatttaattcagaaggctacagacatcaataatgtcactccattaataaagtctacggatacatacaaagggaaagtctttgcaggagatgttatgtggtatcttccaaaaggaaatgaaggatgggatttcttcaaaggtgtctctaatgattcaaactatatcagccttaatggatacagcaaagaagatggggtacgagcaatgtggaaagaatcaatgggctggtatgacactcttgaaaactctcacattgatgtatttgtctcacatgttccacctgttcacaatccttattctccgtttgagcctaacagctgctatatggttgatgtcccgttcattaacgcaaaacattgggtttgtggtcatgatcatttacaagctgagtttgacaatgatggaacgagctttcacatgaactgcattggatatccatatgactatgatatgtatcctagagtaaatgagataccaggtaagcaagttgatacgtataaaacgtttgagctgaagacatttgaaatcaaatgaaattctaattttatacagaagggagaaagtaaaatgtctaatgtgaaaattaaatatgttacagactgtcatgacaaagagtttacattaaataaaaaatatgattttcgtataaccgatgatggtattgaaatcattgatgatttaggtgaagaacatatcattgcaactaaagacaatgaatatggggcttatgaacacgatgaatttttcagatcaagatttgaatttgttgatactgaataaaatgttgatttcatttagaagggataagttcaatgaaagagattgaatttgatgaagttaagaaatttgttgaagtaatgtctagagaatttagatcaacaaagatgatgaaaattaaaattagctatgctgaatggttagttgatgaagttgaacgattaagggggttagtcaaaagtgagcaatagtttagagagaaagattaatattcatttcagtaatggctcacatatcgagtctaaacaactttctaataaactaagggggtacaatagcaatttcttatgggagcaaatgcaagagagtatcacaaaggaacttaaatggtggggagtcactctaactggaaatcagaaaactgtaaaagctttaagtgagctaatgaccattaacaaaacattgtttgagaacctttataaggtgcaatcagacaccatagaagagcttgcaaacaaattatatgaacaggttcctgagtatgagaagaagtttttgaagtttgtcaatgaacagatacctaatctgaggatgtgcctacagttcgagctaccttataatcctcaactaatatccagcatagaatatgaaatttacatatccggtgccgaaattgattgcgaatacccacatgatgctagggattgcattattactttctttcaacggataccagaaataatcggttcatacaaggaggaattagatgaagaatacagagtttaaggtaacaagtttattagaggagtataaacgaagagatgaggaacgtagggaattcatcattcatgaaggctacagagctatcgaagagatcattaaagaagtgaaccaaagaggatcactaaatgaagcagatatttattatggaacacctaaaccacagttaagcttctcggacgtcgaattaggctacatgcttacttctatgatggaatatgctacaaatcatgttggaaatccagttgatgaggaatgtgaacttgaaaataagctggcttactttgagcataaggacgaaattgttcaagtttttgaagtatatggacaaggtactgacagctggtttttgaaaccaagtgacgataccgtttataaattgaataacacagcttacggagtgtatttaaaccagttcgatgatttcattaattacactaaaaataaagacaatgagagtaaaaaggtttcttatggtaccacgatcttaaatgacattgccggcggatatacagttggaagaggttctaagtagatgatcgttacagcttggattttgtttgttgcatttgggcttgttttgttagcaagaatggattccgaagggaatcttaaatttgcagtgtatattggtgtaattaaatttgtttcagttttcattgttgccattgcagcaggagtgatttggggagggttatttcaatgataaagaggattatgagttttaagtttgacgactggagacatattttctacttattaaaaagtgtagcgaagaatttctttaaaggtgattttcatgaagcgagcgatgcactttattggatacgggtacacttgtcttttgaatcaaataaggtgaagtgaacattagataaaatcggtcatttatttagagtaaaaataaaattagatgattagaggtggagagtaataactgagtacattaagaacattcaaatactgttcaacaaaatggaaagacaaatgggtacggtgaaagaagctctcgagaacaaagaatacgaaagagcccaccgtaacctaatcaacctttcggataataatgaagaattgatgcaggaaatcagatgggctcggaaagggattaagatttaacttttcttctttcttcgtggttccattcgtacagctcttcaattgagcaaccaatggcatcagcaaaagtcatgccagtagctaagttcatatttgctttagctccacttatataatcgtggatacgttgtctggggtatcctgtacgtttgaaaaggtcatcaactgtgaggtcatattcaaacattaattcatttaaacgagggcgcaggggtgtccattgcttcatttcgaacacttctttcaatattaattaacataaaacagtgtagcaaaggtttattctaatttcaattttagtttcaatattttaggagagtgattgattgggaggtacaaaccaaggcaaggtttttgaagcaaatatagaaaaatcagctgcaggtcaaaagctgttcttctatagaattaaagatgttaatccagtgtttttaaaaaggggagctgcagtatcaaaaaacaaatatgattgcttcttgcactttaaggggtacttattcccattagagcttaaatcaacaaaggataagtctattgcctttcaagagaagattataaagccgcagcagataaaacacttaaaagaggctacgcaatatccaaacgtaatccctgggtttctatttcaatttagagagccggaaaataaagtttatttcgtacatattaatgatttccttacatataagaacatagctgaaaaacaattgaaacatacatataagaataaagtaaacaaagccagcattccaattgcaatttgtgaagagatcggcacagaagtccgttcgatgaagaaaaaagttaactatacatattacttgaataagctttgcgatgatttgattaaaaaagaacagcagagtgtgagcgctgtatgagtgaattcgttaaatcatcttcaaagcaatcgtttgaaatagaaaaatatcatataacgattgaaagcataaatcaaccatcagctgaagcaattaagaaagtcaacctaaaagtgaatgaagtaatgtctaatttattagcaaaagaaaagagccattaagccggctctttttttgttgtacttaaactataatacttgtgacgattatcgggatgaccttaatgccggtcgcgatgaatcatattgccggcggggaaggcagcaaggatttcggtgatccggctaaccttgccctcggatttacggtgcttgtcatcatcgtgctgctttatcggtttacaaaaggatttttgaaatccatttcaattttaatcggcattgtcatcgggacggccatcgcatattttatgggaaaagtgcaatttgacaatgtggcgaatgctgacgccattcaaatgattaaaccgttttatttcgggacgccgacatttcatgcggcaccgattattacgatgtcaatcgttgccattgtcagccttgttgaatcaaccggcgtctatttcgctctcggtgacctgacaaacaggcgcctgtctgaacgtgatttagcaaaaggctaccgcgcggaaggtctggcggtgttcatcagcggcattttcaatgcttttccgtatacggcctattcccaaaacgtcggcctcgtgcagctgacggggattaagaaaaacgcggtcatcggtgtcacgggcgcacttttaatgctattcggcctttttccgaaaatcgcagccttcacgaccatcatcccgtcttcagtactgggaggcgcgatggtggccatgttcggcatggtcatttcctacggcattaaaatgctcagtcaaattgactttaaaaagcaggaaaatcttctgatcgtcgcgtgttcggtcggattgggactcggtgtaactgtcgttcccgatatgtttaagcacctgccgtcttacttaaatctgctgaccacaaacggaatcgtcgccggaagctttaccgccgtccttttgaatattgtttataatatgattcctaaaacgaaaaaaacccttgatgtgacaagggttcaagagggttagttatccgtttttcttaaaaaaataacattttaataacatttctttatgaaatcccgagatcgaggatgcttccgaaagtttgctgaactttttgtgaggcatcctctttttttattagtttcattgtttgaaaagaaataaattgagtgatgcggcatccgccttatttcgccgaacaaccgtcccgaactatatgtacgtgaacatatgactgaatgtaagaaaaaaaggagaatgggggatcatatcataaacgaatatcattgttcggacggtgatgacacgaaacttggtttagacatggaatgaaatgcctgatgccgaagtgcaactgcagaatgggcgctgagggggagtgtcttgtgcacggatccttacaaaagagagtgaaaagaaggggaagccccttcttttaattaatccatccttcaaaagttgcgcgatagaacccttcgattatctctactttcttaaggtaataagtaacaccatttttaacagttgtatttgggatatcccatctatgaaggtaatccattgtaaaagaatctttgatcgcttgtgtcgaaatttttgtttcagttgagtcgctatttgtattgccagggctggatgcaaaagcaggggaagcggaaacgagtaaagcgagagacaaggcagaaccagttaaaacttttttcaatttcattttaaacactcctttgttttttaatacaattgtattattacacaaaatacaataataaccaagaggttttttgttaatattttgtgggcgcagcgtgaatttttttaggggagtggatggcaaaaggggcaatcctttcatccgctgttgcagcttatttcaggatactgatatgtatatagagaaaaagagttgattattgctggcctctggtgagctgcagcctttgagtgagtgtttgatttagctattccagcgcttttccaacgggaaaggtgtgatatgaaatttaaaactgaaacaattgtacaaaagtaaaaactttatttaaaatgttataaatactaattttcaatataggaggttatctggtggcagaaaagaaaaaagctttaatcattgtggatgtacaaaaagctttcgattataaaaaatggggagaacgaaataacgtaaaagcggaagaaaacattagtaaaatactgaaattatggagagaaaaaggatggacagtcatatacatacaacatatttctgataaacctggttctttattttatccaaaaaatgagggggttgctataaaggagatcgttaaacctatggataaagaggtcattataaccaagaaagtaaacagcagctttatcgggactaatctagaagagattttaaaatcaaatgatataacaactgtcgtaataactggtttgactacgccccattgtgtttcaacaactacaagaatgagcggtaatttagggtttgatacctacctcatttcagatgcaacagcagccttcggaatgaaagaccaaaatgatacatattatgatgccgagactattcacaatatatctctggctacattgcatgacgaatttgccacaatattaacgactgatcaattaatcaatgattttataaaaacaaactgattaacattatagctaaggccggcggtgggtatagcggctgaaaagcatattcaggcgcatacaaggatctcgtctgaaaaaaggcatctgcttcagatgtttttttgtttcttgaaaaacgggctggtaaaaaatgatcggcgcggttaacggtctgattcggctttggttttgaataacaaaaggttttactaatcagcgaattattcaagattttttggcttgtgctgagtctgtgtcttttgatttcctcgaatagattggcttgatcatctttttgtggctgaggctctttgttaagacattttgggtcgatcacatttttaaaatctttgatggttaaaggcttacagtcatcttttaattcgtagcctaattgtccattagcttctaaagtggcatatttaattgaaatgccaagaagccttaaacgcatttcgagttgatctgctgtcagtctcagcttctttaagttttgtatattagttggccgtcttctatatcgaatttagattttccggttaaaaaaaatcaatccagtttacttttacttgaaaccattccatcaaaattaaagcactaaaaggatagacgcagcgattaatgttttcaataaactggtttctaaaatgggatgaacgataatcgtaccgattgaaatcatcaccattgtctgtgcgatggtcatttgtgcaatggattttctccctgaaattctcagtaaaatcattccgaatgcaattataattaattcttcccaagcaaatctcatgttatcaccctagattgtgttttatcaaaaatgaaagagcaagtaagaggtttcttaacgttagctggggaactcaggcgtcgataaaatgttctggattgatagagttgagactcggcttttggatagacacgcgggagagaattttagtttatgtgtttttgcgtctaaaagcagaaacattacaactaataatgatcatcggatgtaataaaattacgcacctaggtgctatatgctggatcaattataaaatggagtgaaactaaaaaaaggggcaaagcccccttatattagcagctttttagttgttacttgagacaatcattccgccgtcatgaaaaatcagcttttgtagacggctgtccaagtgccatcagcaccatggaaggtgatgttgtctaaataataggtgattccattccggtaaattgaagtaggataatcagggccataaccattaagtatgaacgtcgccaaagcagatacttccttcgttttgctttctgcagaaggtgtatcagcaggacctgcggcaaaagcaggggcggcagaacagagtaaagcgagtgacagggctgagccggctaaagcttttttcattttcattgcaaacactccttttcttttttaatacaattgtattattacatattatgttaaacatgtacatgcctatctttgttaattttttgtgaacaaacagataatctatttaaacgcagagatgtaataagtatgatgatgaagcaattatcatctataaaaataagatcagaaagcagatgattttctcgaaaatcatctgctcttgcgaaatgaggagttacatgacatttacggaacgggcggtagccattatcaaacagattcctgaaggaaaagtgatgacgtatggtcaaattgccggtcttgcgggaagtccgcggggagcgaggcaggttgtgaggattcttcactccatgagtaaaaagcatcgtcttccttggcacagggtcatcaatgcaaagggtgaaatcggattaagagatgaagagatattttctgtacagaagctgtctcttgaagctgagggcgtagcggtcacgtcagacggacggatcgatctcaatttatacgtccatgatccgaatatgtaaaaaacctgccgtatatatcggcaggtttttcagttatatgctgcaagccggccagaaaggttttgccggatataaggccattcctcccgaaggatggagtagtaggcggtatctctgaggccgccgtcgacagccggaatatgcgcgcggcggatcccttcaaattgggcaccgatccgcaaaatcgcagttcgtgagcgctggttgcgaacatcggttttcagcgtcaccctgacagcttgccacgcgtcaaacgcatgggtcagcaacagaagtttacattccgtattgacaccggtccgctgtacggcagaggcataccatgtgctgccgatctcacacacttccggggctgcgtccgccggccgcgtaaacacttccgcatccataaaccgcgtacttccgacgattcggtctgtttcaagattccgtactgcaaatggcaatgcaagtcctttttcataatcggaaagcgtacgttcaatataacgctttgtttcttcgattccgtcaggaacatgggtgtaagcgtaagtcgtcctattttctgaagcagcttcacaaagtgcctgagtgtgatcaatcgtcatcggctctaactgaacgagtgaccctttaagaatgacgggcttcagcattcttatcacaacctttttttatgaatggatcaagtatagtcgagcggcttatcattcaaaagggccaattttaaattaaaatggcatgtcagtgaaatcctcgcttcaaacttatgcatacattcaggaaaaaagcggaaacctttatgtgaagaggtgatgggcatggcatatgtgttatcggtcggaaccagcattccggaatatcatgtctcgcaagaaacggcggcggattttgcgagagggatgtttgccgattcatttaaggatattgaccggctgttaaaagcctttcaaaacggcgaaattgaatcaaggcagtttgtccggccgattgaatggtataaaacggcgcggggtttttcagaaaagaaccggctgtatacggaagaaaccgttaagcacagtgcggatgcggcacttgattgtttaacaaacccggattgtttaacaaatccctttccttatgaaaaagtggatgcgatcttttttatttccagcaccgggctttcgacacccagcattgaagcgaaagtgatgaatcagctgccgttttctgcgaaaacaaaacggataccgatctggggcttaggatgcgcgggcggagcggccggcctgtccagggcgtacgaatactgccgcgcatatcctgaagcatacgtgcttgtcatcgcggctgaactctgcagcttaacgtttcagccgaacgacaagtcaaaaagcaacttaatcggaacttccctgtttgcggacggaattgccgcagtactagtcggaggagaaaaggcgaaccgaaacgacgtcaaacagccgcttcttccgcggatattcgccactcaatcggtgatgatgccggatgcggaagatgtgatgggctgggaattcaccgacagcggttttcaagtcattttttcaagagatattcccaccctggtttcacagtggctgaaggacaatgttgatgaatttttaatagaatatggtgtcggtcctcacgacattaaaacctttcttgcccatccaggcgggaaaaaggtcattgacgcctatttaacgagtctttcaatggacaccggtcagcttgaggcatctcggaaggtgctgcaaaaacacgggaacatgtcttccgcaactatttttcatgtgataaaagaacagttgctccgcggccggcagaaagaaaacgaaaaagggctgatcggcgctctcgggccgggattttcgtctgagcttttgctgttcagctgggaaaagggggcttcttaatgttttggctgtttatcatgctgcttgcggcccagcggattgcggagatgatcgtggcccggcgcaatgagcagaaggtgaaaaagcaaggcgcagtcgaatacggagaaggacattatctctttctcgtcctgatgcacgtgctcttttttgtctctcttacagctgaggtggcggcgtttcaaaaaacgctttctccaaggtgggccgccattatatgtattattttatttgtacaggggatcaggtattgggctctattatcattagggcggtattggaatacgaaaattcttgtcgtgccggatgcggagcttgtcagaaaggggccgtacaggtggatgaagcacccgaactacgcggtcgtcatcttagaatttatttttctgccgctgttatacggagcgtattggacactgtttctcttttcgattctcaatgcctgcatgctcactgtaaggattcgcgccgaagagaaagcgctagaagaaaacaccgcaaaatagagattgaaaatcattctcactcatgataagatgtaaatatgaaaatgattctcattcaaggtggtgccgaaaatgacaatgttatttttatttgcagccgtttgtacatacagtgttttaattggtttcgtattgaaaaaagtttcgaataaatcgatgtcttcttaaacatctgcggtttttaatgccgcgggtgttttttctttatcagctgccgatatcggcggcttttttacgtttcctgaagaaaagtgggccattcttgtgtaaaatgggggagaggtttttttcagagctttctaaaaatgaaaacgtcatttgatgcgacagacacaaaggggttaagacacatgacagaagaagaacgccataacagggagattttcagcagaacgggtgccttatacgtacaattattggatcaccaggatgaaaaacgggccgatcagctcgcggccattatgaaaaaagcggctgatgaagaggtttatatcgcgtttaccgggcattattcggccggaaagtcctctttattaaacacattgctcggtgaagacatactgccgacaagcccgattcccacaagcgccaacctcgttgtcatccggcacggtgaagataaagtcgtgcttcatacgacggacggggcttatgcagaaattaaaggaagttacgataaaaaacaagtgcagcaattctgtaaagacggtgagcaaattgaaacggtggaagtctatgccggctttaaggagtcagagccttatgcggcctacattgacacaccgggaattgattcgacggacgaagcgcattttttatctgccgcttcggttctccaccaggctgacgctttattttacgtcgttcattataatcacgttcattcagaagaaaatatgctgtttctcagctccatcaaagaccgtattccgaatttgtttctgatcgtcaaccaaattgacaggcatgatgaaaccgaaacgaagtttgaagagtaccgcaggcaggtggaagatatgcttgaaggcgcgggaataccgaaagaatcgcttttctttacgtctgtcactgagcctgaccatcctttaaacggcatggaacagctgaaaaaacatctgcagaagctgaaacagcaggcaaaaacaaatttatggtccttaacggagagaaaagtcgcacacttagtcaaagagcatacagagatgctcgtaaaagatgataaaaacggaagcggagagcagtttgacaaacaagaagcacttgtccgttctgttgaagatgagcttaataaagccgttcaacaggctgaaacagcagagaaagacatcagaaaagacgtgcagaacatattgcaaaacgctaatttgacaccctttgagatgagggagcttgcatctgcttatattgaatcacagcagccctcatttaaaaccggattattcttttcaaaagcgaaaacggctcaggagaaagagagaaggcatgctgaattttttgccgatattaaaaaaagaacggaaggggaagcggattggcacattatcgacacatttacgaaagcggccaagcggtatgaagcggattcggacgaactgatcaagaaaatccaggcgtaccgcacaccgctttctgatgatatcaccgctcaggcccttaagcagggagcggccttttcatctgaatacgtattaacttatacgaaagacctcgctgagatgatcagaagggaagccaaaagacagacagcggaactcattgagaagcttaccgcttatgttcaggcaaaaaacggaccgctcattgagaacttgaaaaaccggctcgaaaaagaaaagaagataagggatgagctcgcgcaatcggcaaaagaagaacgcaatgccttggaaaaagcagcccgggtccgcgctttgtgggaagaagaattgacctgtgatacgggaagcggcgactggtatacgcgaaaaaaacgccttgcaaaagcgcccgtccaaaaagagaaaccaaaagagactgtacagtatgaagtaaacaaacccgaaaaaaatgcgatgaaggaacttcctataaaagagcagactgatcggttctatgagcttgccgggattcttgaatcctcgagcatattaggaaaacaggcagaagcctttcgaagcaggattgagcggcttgaaaaccgccagtttaccttggcgttattcggcggattcagttccggtaaatcatcatttgcaaatgcgcttgtcggtgaatacgtgcttccgtcatcaccgacgcccacaacggctacgattaacaaaataacgaaaccgcaagccggcaaaccgcataaatctgcggagatcgtttttaagacggaggaggatctggacgctgaaatgcttcagctgactgagctgaaagacgctgatgtaaaggggcgttcactgaaagagagatggaattatgccattaaaaaggggaaagttccggatgaacttatcccggtgattcagacgatgctgcaggcgtttgatacgtatgaagaacagatccgtcaaaggcagacactgacggtgccggtggaagatttaaaaccgtatgctgccgaagaaaaaacggcctgctgcgtaaaagaagtcaccgtgtattatgattcgcctctcacgcaaaaaggcatcacaattgttgatacgccgggagcaagcagtataaacaagcgccatacggaacttgcctttcaatatataaaagatgctgacgcgttcttttatatgacgtactatcagcattctttttcaaaaggagacaggtcttttctgaagaaactcggcctcgtcaaagaatcattcggcatggataaaatgttttttgtcattaacgccgccgatctggccaaaaccgaaagcgagctggaaaccgtcaaagactatgtccgctcagaactctcaaaagagggaattaaccggccaaaattatatcatgtctcaagtaaagaagagcttgcgggtaaaaaagcagctttttataacaggttctctgatgtaagaaccggacttgagcactttattgaggaagatgtaatgagggccagctgcgcccagctgaaaacagaggcggacaaattgtgcgatatggtggaacagcttcacgaatctcttcaccagtcggcagaagaaaaagagaaaaagaaacagcatctggagtcttcctatgaaaaagctctcgctgacatttcaaagcgccgtacgtctgaggtcatcattcgaaaagtgatgaaagatacggaagaacagctctatcacattaaacatcgcctgacattttatgcgaatgatatgctgaaaaccgccttccatccgggccttcaaaacggcgattggaaacaaaatatagcagcggcgctgaatgaagcgctcaaggaattccgttttgaatatattcaagagctgaaaacgctcgatatccggatgaccggttttattgagcgccatatgactgaggaatggatggaaaactgtcagaagaagcttatggaagacggagatttctccatttatgtgagcgccgaaaacgaatttgccgttcagctgaaagaagtcgctccggtcattgacgtctcggcattcacacatcacataaaagaagttaaatcgccgaagcagttttttgaacagaacggaaaagcagcgtttgtagaagggctcaggctcagcctgcaaaaagtgacagaaaagtggcttgagcaggagaaagaaagcctttcagagcgatatactgagcaggtgcgccgtctgcaagaagacatggcggataaaagcctgtcccagatccgcgagcagcgggacacttatttacaaggtcttgcggaaaatacgagtgcaagggaaattgaacacctttacgaagccgaaaaagcatggaaaaagaaagatgaaatgctgaaaatttaaaaatccggttggcgggcagataacagtcgtggtagactaaaatgaaaaaagcgagatgaaaccttttatgtcagaagtccataaagcaatttcagcacattccgcaaaacagcatcagcacgtcaaaacatttgtacagcttgactaccagcgtgaacaggccattgaagaagccattgtaaaatgcagacagaatgaaccgttcacgacagatgccatcaatggcattaccgcaaaaatgaaccagctggcgaaaaagggcatcgtgccgcaaagacgattcgtaagtgaagagatggtgaaagaattcgtcagcagacagtaatggatgaacctgccgcgtgtgtcatcagcgcttgctgtacatactatccgtatcttctctaaggggggatatgacaatgggcagaacaaaactgggaaacagaaatgttcagcagaataacaatgccaaaaagaaaaacggtttcggacagaaatttgattcttatgccggccgtgaagctgaaaagctgatggcaagcaataaaagacacggtgagtaacgtgacggcagcatcttccaaatggggggatgctgtttttttaccgccttctttggtaaaataggaacattgaataaaaaaaggagtttcgatatatgaataacaaattactgctcgtggacggcatggcgcttttgttccgctcgtttttcgcgacggccgttcatcgcaattttatgataaatgaaaacggaatcccgacaaacggcgtcaacggttttttaaagcatctcattacggcggttgatacgtttcagcccacacatgtcgtctgctgctgggatatgggaagcaaaacgtaccgcaatgatttgtttcaagattataaggccaacagaagcgaaccgccgcttgagctgattccgcaatttgatttagcgaaagaagcagcgcgagagctcggttttttaaacatcggcataaaaggctatgaggcggatgactgtatcggtacgctttctgccctattttccggagaagcggaaattacgattgtaacgggtgataaagatctgcttcaattgatgaatcatcaagttcaagtagcgctgctgcaaaagggtatcggcaattataaggtatatacagatgagatattcagagaagaaacgggggttccgccaaaagcgctgattgacattaaggcgctgatgggagacacgagcgataactatcccggcgttaaagggatcggggaaaaaacggcgtacaagctgatccgtgaatacgaaaacatagaacggttattagaaagcctcgctctcttgccgaagggccagcaaacgaaaattcagcaaagcttgaaagaattggagctgtcaaggcagcttgctgaaatacattgcgaggtgccgttagtctgtacgcttgaagaagcgattttttcattgaagatggaagaagcatccttaatgctcagacgccatcagataaaaggaattgaaagaatgctcgaaaagctgaacgccagagagatcagctgatccctctagcgttttgtattgcttttttttgcgttgttttcaagggctgatttcgggtctttatgcgcatttccttccatatttccctgaggattcacgcccccggtctgccggcctttattttcttttctcatagctgttcacctcatttgtaggatgaacagtgaaacgcaatttcattccggttatttattcagccggaccgctttttttgcgagctgatcggctgtttggttttgtctgccgggaatccacttaatgaaaaacaatggaaatccggcctttaagcggatgatttcatccacaaacggctggaaagccttgtttttaaccgcttcaagttccgcggcccgctccacgatatctgaatccgtccggaatgacacggactcaaatccgcgggcggcacacagcttcattccttcaattaaagcgagaaattcagcttcctgatttgaatggtcgccgatcggaattgagaaagattctgttttcccgtcatgtttaataaaaataccgataccggaggggcccgggtttccggcgcttgcaccgtccacgtaaatttcagcaggcatcatccgtcactctcccttcggtgtcattcgttttgccgcatacgcataagggacagaaatgagtgataccgcaaatttaatcaggtaagtcgaaataaagatgctgaaccatacgcccgcggaataaacgccgataaaggccacggcagtgaagataaatgtatccagcagctggctgagcgccgtgcttccgctgtttctgagccagagaagcctgtctgaaggaaagattctccgaatggctgaatatacataaacatctatcgtttggctgaaaataaaagccaagaggcttccgagtgcaacacgcggcagaaaaccgaaaatcgtctcaagggcaggctgcgcgatatctgacgcagccggtttatataaaagagccccctgcatggcgcatgtcaaagcgagcaaagtggaaaagccgagccagacggctttgcgcgcttctctgggaccgtatttttcattcagcacatccgttgcgaagaaaacggtgccgtacatgatatttcccagtgtcgccgtaagcccgaacagctcaactgttttgacaacctgcaagttggcgcacaccgtggcgaaaccgatccatacgaataggcccgttttgccaaatcctttataaaacagaagaacaatgataaaatgaatgaccgcaaataagatccataacacatcgttaaacaaaacctgctgacttcctttcaatttgagaatggtttgattatagcacacgcccgtcaactaatgaatggtaaggtgatttcaatgaatcttaagccgtatatcgaaatagaagcaaaaggaacaggccctgtcgcgtttttttccgaagattggctgaccgttccgaaagcgcgcatgcttgcaagagaagtcagccgctttccttatataaaagacatttattttgaggatgaaaaaggcgcgagctggacgcttaaagaattagaaaagcttactgaagaacttgcgtacgaacctgacgacattacagtgtatttcgacggcggctttgacaaaacaagcggacgcgccggactcggaattgtcgtgtattattctctcggcggcaagcggcatcgcatacggaaaaacaaaagcttaacgcttcagacgaacaatgaggcggaatatgccgctttgtacgaagcgcttaaggaagtgcaggaacttggcgcaagcagaaattcaatcacgataagaggggattccctcgtcgttttgcatcagcttgacggcagctggccgtgttatgatgaaacgcaaaacgaatggctggataaaattgaagcgctgctcgaatccttaaagctgacaccgacatatgaagccgtaaaccgaaaggaaaatcaagaagcggatgaccttgccagaaaaattctctcggaccggcagattgaaagccgcataacattagaaggtaacggagatgactgatattggataaaaaaagcatttataaagaattgacagagcttcaggatgaatattgcaaagactgtttcgtaaaaaagcatttccgcaaagagtttggaaaaacgcacgctcattctttctgcatcaaccaatgcacggtgggggagaagctgaaagcctacggcaaggtgctgacaaatcaataaaaaataaaaccgcagcttctgcggttttatttttcgaattcatcaagctgatgctggcaatcgtcgagaagcattcgctgcttttgcagaaaatcctggtcgagagcttgcagttcactggattgtgacatcgttctggcatcctgaatcgcctggtaagcagactccaccaaagttgaactttggccccgggtagccgctcccgttgttttctgggccgtttccaccgctaattcaagctggcgtttatccgtcagtccgtttggaaaaaattcagagtccattaaaaaacacctccgcaaatagtttggagattttttttagaaatatgtacggaaaatagaaaaaaatatagaaaataagccgatataactattgaacctgattaattagggcttatttactattattcagggtatcttgggagagaagggaaaaaccagccgtgaatgataatgatttaaaaacaatccttcagcagacatttaaagaaatatacggtgatctgggaagtttagcggaaatggcgaaaaaaggaatgccgtcaatggagaaacaaattgaagaaatcgagcagcgctgtaagcagaatcttgtcgcaattgagattcagacggcaatcaaataggagaggcatacgcctctcctctatttgtcatctgatcaacatgtattgagtttagagttttacaacattagaagcttgaggtccacgattaccttcgacaatttcaaaagaaacttcttgtccttcttctaatgatttgtatccttctccttcgatagcagtgaagtgaacaaatacgtcgtctccgccttcaacttcgatgaagccgaatcctttttcgttattgaaccattttactttaccgttttgcatattgcttaattcctcctagtactgtagcaccttcgtgctaaaaaaaattttgtcatcatccaaccgtacgtatgtaaacgttgttaaatgatggttcaactatacaccatatgggagcgggcgtcaagcggccgctccctattttttatctttatttttccagtaacaaagcttaaccggaaaaaaacaaaaagcacacgaatcgttcgtgtgcttttcttttacgataatgccatatccgccttcccggccatcatttcagattcttttataatgtcctgcaaaatgacttcagaagagttggggaggtgaaggcttttaatattgctcttcatccggttcagcttctcctcatccgcaagaagggaggtgacagactctaaaatttcttcgtggcggttgaccacgacagccgcaccgcgatcttcaaagaaaatggcgttttccttttcctgtccgggaaccggtttgtacaaaataacgggtacgccgatcgccgtcgcttccgtcagtgtgatgccgcctggttttgtgatcatgcagtccgtaatacggaacagctcgtcaattctttctacataacccagcactttcagccggtcggcattgtcaccttccaagctgctgagggattctttcagcgagctgtttttgccgcataccaccacaacctgcacctgatcgtcatgaacgagattttcgcacagttcttttacgtttttcagcacaccatgcgctcccgccataataagaagaacttttttgtcgggagagagattgtattttttataaatcggctctttcggcatcgattcctcgaattgaggcctgatgggaatgcctgtgatctttacgttgttcgggtgagtgccgatttcaatcagtttttcctttacgtaatctgtggcgacataatatttatcaacattttcatgaacccagattttgtgaaggcagaaatcagtcattacgttgaacgtggggatcacttttccggttctccgtctgtattccggtacgacaatcatcggaaatgtattgataataatgtccggcttatgctcttcgacgagctggcctaaacgtttatttcccattttaaaataaatattgaatttgcgtttattatagattttgtcaactccgtaataaaacaaacgataaaactgtttcccgattgagaagctttttaaataaaggtattgagtaacctctgaaacaatcggatttgactcttgatacaaattggaaaccgtcacatctaagccgagacgcagacattgttcgtagagcgttttggccacttgaacatgcccgtttccgtaatttgcagtcaaaattaatacttttttattggtattcaagtaaattcacctcaatgtaatcaacaacaagcaagcttcatgcatcgtaaggagttattgtctatagataaacataacacaagtgcatcattttataataagcgcgccaacatatttaaactaaatttaattgatatgttccattattttaaagttttgttatacgcatactgaatcaagagtattttatcatatttttgtcaccgtatcacttaaaacaaaaattaatcccattcatacggagtttcctgatatacgtaataattcagccaattcataaacaataacgttgcatgagctttccagcggttaacaggttctttcccgccgggcgcaaaatagtgcttaggagcttctacgtttgaaagatttctctctatgtctctctcatactcctgaagcagcgtatcggtatcatattccggatgacccgttaagaaaatctgtttttcgtcttttgaaacgattaaacagacccccgcttcctctgaaacgctgagcacattcagatccgaagccgattgcagctgctccgtattaatatctgtatgccgtgagtgtggcacatagtatagctcgtcaaatcctcttaccaatctctcatgttttttaagaacggtatgctcaaacacaccgaagatttttttcggcagctccactttctcaatgccgtaatgatagtataaaccggcttgagcgccccagcagatatggagtgttgaagtgacgttcgttttgctccattccatgatttccttcaattcttcccagtaagaaacatcctcaaacggcaggtgctcaatcggagccccggtaataatcattccgtcaaaccgtttgtggcggatgctggaaaaatccgtataaaattcatccagatgctgccttgccgtattttttggagtatgtgtgctcggaattaaaaacgtaaagtgaacttgtaaaggtgaattcccaagcatcctgaggagctgggtttccgtttggatttttttcggcatcagatttaaaatcacgatcttctgcggccggatatcctgatgaaaagcccggctttcatccattacaaagatgtgttcactttcaagcacctgcttagcgggcaggtgatttggtatattaataggcaacatgccacctccgttattccccgttaattttcttcattatagaaatttttaagccatttttcaatccatcccggcgtaataaaccgtatttaacgcataatgacagggataaaagcggcaaatgggtataaattcggagcggctcttttattatgacgggtaaagagccgtttggttcctcgaaaaaaacgttttccgttaagtggaaggaaaaagcggttaccgtttgttttgcagtgtaaaacaggtaaaataaatgaagaatgtaaaaaggagggccgcagatgacaatttacgatataaacgtacggaccataacaggcgaagacatgacgctatcggcttacagaggcaaggtgatcatcattgtgaatacagcaagcaaatgcgggttcacatcccagctcaagcagcttcaggagctctatgatacatatcgggaggaaggtcttgaaatattgggatttccctgcaaccaattcatgaaccaagaacctggaaatgaagcggaaattcaagagttctgtgtgaaaaactacggagtcacattcccgatgtttgcgaaagttgatgtcaatggggcagacgctcatcctctcttcaaatatctgacggaacaggcgaaggggatgctcggcacaaaagcggtcaaatggaatttcactaagtttatcgtggaccgaaacggtgaagtcaacgggcgtttttcaccgaacgtcaacccaaaagagcttgaagatacggtgcagaggcttttggcccgataagaggtgatacggtgaacgaaaaagagcagctggaaagcgtcaggaattgggtcagagaaaagcttatcaatgaacgtacgggccatgactggcttcatatttcccgggtcgcaacactttctgtttatatggcaaaagaagaaggcgccgacttatttatcactgagacggccgcgctggttcatgatctgattgacgccaagctcgaaaaaagcgaaaggctgacggcaggcgaagtgacagaacggctggctgctttcaacattgcggctggctccattgaggagatcgcggatatcatcacgagaatgtcattcagacacagggaactgctgataaagcggccgctttccttggaggggaaagttgttcaggatgcagacatgcttgatgcgatcggcgcagcgggcatcggcagggcttttatgtttgccggcgcgaagggtcacccgatgtacggaactcaaacaagtgtgctggcccatatagaggataaattaatcaagcttaaaggcttaatgaatacaaaagcgggggcgggtttagcagaggagcggcatcaatttcttttgcagttcgccgcccgtatccaaaaagaggccggcatcggcaaaagctaagcggcgcaatagaacgcttgtgccgactatgttagaataagtgtcagattgcgcataggaggaccaatatgaagattaaatcaatagaaccgacgccgagtccgaacacgatgaaagtgattttgactgaagagcttccggcggggaaaagcaacaattacaagcctgatcaggcagatgatgctccggccgtcgtacgtgatattttaaacattgaaggagtaaagggtgtttatcacgttgccgatttcctggctgtggagagaaacgcccgttttgactggaaggacattctgcctcaggtccgttccgctttcggaatggaacatacggagcagtctgagagccgttctgaacaggaatcgttcggtgaagtgaaggttttcgtacaaatgttcagcggaatcccgatgcaggtcaaattgacggacggcgaacgtgaagagcgcttcggccttccggaacgtttccaagaagccatcttaaagctgcgttccgaagcttcaaatgttgtatttgagcgggcttggaaagaacaaggcgtgcgcttcggggattttaccgaaatcggacacgatgtcacagaagagcttcaggccgcctacagtgatgagcggctcaaacgcctgacagaagcagccgtacagcaaaagggtgaggccaaaccggcagtgcagcggaaagcttataaagtgactttggaaatgctcgatgatgaagactggaaacagcgctatgcccatcttgagcaaatggatccggatgaagacgatttaccagtattagaaaaggcgctgcatgatccgaagacttcgatcagaagacaagccgtcgtttatttgggaatgatcgaaaagccgtctgtgcttccgctgttatacaaagcgcttgaagacaaaacggtgacggtcagaaggacggcgggtgactgtctgtcggatctcggcgatgcgagcgccatcccggctatgacgaaatcgctcagtgactcaagcaagctcgtgcgctggcgcgcggccatgtttttatatgaagtcggcgatgaaagcgcactggaagcattaaaagcggcggaagacgatccggaattcgaagtcagcctgcaagtcaaaatggcgattgaacggattgagcacggagaagaggcgaaaggttcagtctggaaacagatgactgaaagcagaaaaaaagaacagttataacaaaaaggtgcgccatgcaccttttttatttgaattcactttttataaaaattatttagaatattgttgaaaaatgattcaaaactctatatagtaagtacaatattaattgttggagggtttttatcgaaatacagaaagaatagaaaagcgagacagggcaaagacgctgtaaacaggtaatttgcagaacgcgccctagaataaactgaaaattttaaaaatagtgcacagtctaaaaacagtagggggatcaccatggcagaattacgcagcaacatgatcacacagggaattgacagagcgccgcaccgcagccttcttcgcgctgccggcgtaaaagaagaagacttcggcaagccgtttatcgcggtctgtaattcatacatcgatatcgttcccgggcatgttcacctgcaggaatttggaaaaatcgtaaaagaagcaatcagggaagcgggcggtgtgccttttgaatttaacacgatcggagtagatgacggaatcgcgatggggcatatcggcatgagatattcactgccgagccgtgaaatcattgccgattcagttgaaacggtcgtctcggcgcactggtttgacggaatggtctgcattccgaactgcgacaaaattacgccgggaatgctgatggcggctatgcggattaatattccgaccatttttgtcagcggggggccgatggcagccggccgcacaagcgacggccgcaaaatttcgctttcttcagtatttgaaggcgtcggcgcatatcaagccgggaaaatcggtgaaagcgacctgcaggagctggaacagttcggctgcccgacgtgcggatcttgttcaggcatgtttacggcaaactccatgaactgtctgtctgaagcgctcggtctggcgcttccgggaaacggaacaattctggcaacttcaccggagagaagagagtttgtgagaaaatcagcggcccaattgatggagaccatcaaaaaagacattaagccgcgcgatattgtcaccgaaaaagcgattgacaacgcctttgcgttagacatggctctcggcggctcaaccaacacagtgctacatacgcttgcgcttgccaatgaagctggggttgagtactctttagaacgcattaacgaagtggctgaacgggtgcctcacttatcgaaattggcgccggcctcggacgtcttcattgaagatctgcacgaagcgggaggagtctcggcggcccttaatgaattggcgaaaaaagaaggggcgcttcatcttgacgcgctgactgtaacaggccgcacactcggagaaacaattgcgggtcatgaagtaaaggattatgacgtgattcatccgcttgacaatccgtttaccgaaaaaggcggtttggccgtcctgtttgggaatctggctccggacggcgccattatcaaaacaggcggcgtacaggacgggattacaagacatgaaggccccgctgtcgtctttgattcccaggatgccgcgcttgaaggcattataaaccgcaaagtaaaagaaggagatgttgtcattatccgttatgaagggccaaagggcggaccgggcatgccggagatgcttgctccgacgtctcagattgtcggaatggggcttggcccgaaagtggcgcttattacagacggccgtttttcaggagcgtcccggggtctttcaatcgggcacgtatcacctgaagcggctgaaggcggcccgctcgcattcgtagaaaacggcgaccatgtcatcgttgacatagaaaaacggattttggacgtacaagtgcctgaagaagaatgggaaaaacgcaaggccgaatggaaaggcttcgagccgaaagtaaaaacaggatatctggcccggtattccaaactcgtaacaagcgccaatacaggcggaatcatgaaaatataaaacagaggcctgaacaattgaattccggccccctctatagtatccttgacttcatataaggatttttagagggggcttttttatgtcaatggcttatgaagaatatatgcgccagctggtcgtgccgatgcgccgtgagctgacgggtgcgggttttcaggaattaacgactgctgaagaagtagaaagctttatggaacaggcagagggcacgacattggtcgttgtcaactccgtgtgcggctgtgcagccggtctcgcccgtccggctgcgactcaggctgttttacagcatgaaaaagcgcctgatcatacggttaccgtatttgccggtcaagataaagacgcaactgcaaaaatgcgtgaatattttacggggcaggaaccttcctcgccatcaatggcgctgttaaaagggaaagaggtcgttcattttattccccgccacgaaatcgaagggcatgacatggaggaaattatgaaaaatctgacggatgccttcgatgcgcactgctgaaatgcccgaattccgggcattttctttttggagaaaaagatgatcacaacgagttacagaccaagcgaatacacgatacacacagcgcagtcactcagtgtcaggctgggtgacacttactgcagccgcaataaacagcccattgaaaaaatgctggaacgagccgctagcgatcttttagtcatcggaaaggaacggttcgaactttacacgaagcaaggggagaagttcttttttcacccgaatacagcgatgttccgcgcaaagcggtttttgagaggggaagccgagccgttgttaaaagcagccggattacgcgagggggattcctttttagattgtacgctcggcctggcatccgatgcgattttggcaagcctggcagtcggaaaaagcggacaagtcatcggcctggagaaaaacaagcttgtctcattgcttgtagaaacaggacttcaaacgtgggaaaccggaatggagcagctccaaaccgccatgaaacgcattcaggttaaacatgccgactgcgccgattatttgcgggagcttcctgattcatcggtagatgtcatttattttgacccgatgtttcacgaacctgttgaaacgtcagacggcattgcaccgctccgcgcgctggcagaagagggttttaacgaagagtgcatcacgcaagccgtccgggcggcgaaaaaatgcgtagtgcttaaagaccattggaaaagcccgcggtttgaacgatacggcttcaaggtgctgaaaagaaagacggcgcttttccacttcggtgtcatccatgtaagctcatgatatcatgggcttctttttcgttaatcagtgatttccataacgacaaaataaagcagcgtgagaagtgatacagtcgcaaataaagcgttaatcatctcatcccctcctttttctccttcttattgtaagcggtttatccactcggtcacagttaccaatttcccatattgcatgataatacggtgccggacatgacgccgcgctttaatctatgctaaaataaaggaaaagaggacaataaaacagaggggaacaatctatcatgaaattgtggatgaaaaagacccttgtggttctgtttaccattgtaacgttcggactcgtgtctcctccggctgctttgatgacagacaagccttcaggacagtcgagcagtcttgagcagaatgattacaccgctttttatgatgaacacgccctgacgggagaagcgaaggcagggcgggagcctgaattactgtttcaatcgtatcagcagcagcttctcggtgatgctgaaaatcaatcatttttaaaattcggcagcaaaatctctccggtcattgaagatgattacagaagtgaaattctgccgaaaatcgaagatgtcatcacaggacatttagccaagtttcaagatgatgaagcgtatcaggatgtggttatttccagtaaaccgtcggccggaaaaactgaaaaaatttttcatgtgtataacaggctgacaggtgaagatcttttaaggttccacgtccgccgggatcatcctccgcaagacggctactggtttaattttcattaccataccgctgaagacggatttcaatcacatcatgagctcggcagcatttactgggaccgcaatacgccgcctgactggatgagcgtgtaatagcgagaagaaataaaaaaatcatttctgagaaattttgcagaaatgattttttattgtgttacactactaaaagactactttaaaaggatgaaaaaaatgaaacaatataaagatttgtgccgtcatgtgttagaaaacggagaaaaaaaaggagaccgtacgggaacgggtacgatcagcacgttcggctaccaaatgcggtttaaccttcaggaaggtttcccgatgcttacgacgaaaaagctccattttaagtccatcgcgcatgagctgctttggtttttaaaaggagatacgaacgtccgctaccttcaggaaaacggagtccgcatctggaacgaatgggcggatgaaaacggagaactcggaccggtttacggctctcaatggcgttcgtggcgcggagcggacggcgagaccattgatcaaatctcccggctgattcatgacatcaagacaaacccgaattccagacgtttaatcgtcagcgcctggaatgtcggcgaaattgatcatatggcgcttccgccctgccactgcctgtttcagttttatgtcgcggacggaaaactgtcgtgtcagctttatcagcgctcagcggatgtctttctcggcgtgccgtttaatattgcgtcttatgcgcttttaacaatgatgatcgcgcatgtgacgggacttgaaccgggtgagtttgttcatacattcggagacgtccacatttaccaaaaccatgtggagcaggtgaatttgcagctgacaagggatgtccgtccgctgccgaaactgcggtttgcgcgaaatgttgattctatttttgattttacgtttgaagactttatcattgaggattatgacccgcatccgcacataaaaggagctgtcagcgtatgatttcgtttatttttgcgatggatgagaaccggctgatcggaaaagataacgatctgccttggcaccttcccgatgatctcgcatatttcaaaaaagtgacgacgggtcacaccattgtaatggggcgcaaaacgtttgaatcaatcggacgcccgcttccgaaccggcggaacatcgttgtaacctcacgggacgaatcttcattcccgggctgtattaccgccgactcggctgaggaagtgctcaagctgatcccggcggatgaagaatgctttgtaatcggcggtgcccagctgtacagtgcgctctttccctatgcggacagactttacatgacaaaaattcaccatgtctttgaaggagaccgtttttttccggaatttaatgaagctgaatgggaattgacctcccgcaaacagggagtaaaagatgaaaaaaacccttacgattatgagtaccttgtatacgagaaaaagaattaagcagggggacaagaattgattcgttacggctgccttgtgatgtacgttgtatttatgttcatgaaaaatattcaggaatatatcaatcaaaaagagcttgacccgcggctctcttttcaaaaacagatgaggctggtgtatgagcggccgaaagcctttatgagaggctgcattgacgtgtcgggatcggcaatcggcattcatcatgatcagccgataccggacggccccgtattgtatgtgcatcccagattgcgcccggctgatcttctgctgcttgcgggacatcttgaagagccggctggttttatcgctggcgagaaagctttccggatgccgtttctcggaaattggctgcgtctgatgggtgtcatttgtggcggagacagccgggatgcagtgcttcaggaggcggaagtccggctgcaaaaagggcaaagtctgattctgtccgaagacggcaaaatcaatccggaggaactggcccttcgtttcgatctcccgattgtgcccgtcagcacttcgggaacagaccggctgctgcggggcaggttattgaaacggctgaaaccggctgatattgaattacatataaagcccgcttattatccggccggtcagaaacggctccgtgcataaaaaaagcacagtctctatacgagaggctgtgcttttttatttcagataaagggaactttgacgcaataaaacaaaatacagaaaaacatcgaggcgctgccgcctaaaacaaaactgtgccaaatggcgtgatgatacggaacttttctccaaatataaaatattgtgccggcggaatacaataagccgccgaaaagaagaaggccgaaaccgggacctgacagcgaagcgtacagcggtttaatggcgatgatgatcagccagcccatcattaaatagacaagcgttgaaaaaatgataaaccgcttcacaaaaaagattttaaacacgatgcctccgatggcaagcgaccaaacaataattaaaagggtcagaccgagcgtccctttaaggggtcctaataaaaatggcgtatatgttccggctattaatacgtatatcgcggaatgatccacaatttcaagaatgtctttcgtttttttatgctggatgctgtgcaaaagagtcgagctgagatacagcaggagcattgaagcgccgaatatggaaaagctgacgatgtctgtcggcgagccgtatttcaccgcaaagataatgagaaaaataagcgccggaatcgacagcaatacaccgattccgtgtgtgacggcatttgcgatttcttcttttattgtgaacaatcaaatgtcctcctttttaaaggatttgtttttgcagtgactgcaaaaaggtcaacccttctaatgtgatttttgttcctgcgcgtcctcggccttttgtcacatagttcatcttttctaagtaatcaagcctgtttctgacttgctggggcgttaatgtcattgtgctgttttcgcttaattcggatatgctccgtctgctggcgggttcgccttttgtatttaagtctttaattgcttccaaaataaacaaaaactcttctttctccatcaatgtcagccgtttttcttttttcttagcggttttcgctttctggctgtttttgatatacggcgggacatgctcgggataaatcgtgctgccggatgctgccgcggccatatagtgcgccgcattttcaagttctctgatgttgccgttaaaggtgtgccgctcaaacagcggataaacggacggatcgatatgaacatgctgccccgaggctgtcagcatatgctgcagaagaagcggtatatcgctttttcgttcagataaagcagggagcggaaggcctaacacgtgaagcctgtaaaataaatctatgctgaacgtgttttccgcgccggtatcgccaagattcgccgtgctgcttgcaatgatgcgggcggaaagcccggcgtccagctcggaaagaaggcgggcctgtaccgagagcggcatgtctccgatttcatataagaataatgttccgcggcgggccctgtttaatgcgccttcagccccgaacagttcatattcgagccgctcttcgctttgactgcagtgaacggtaataaatagttcgctgtttctgcgggatttatgatggatcgctctggccatttgtttttttccggttccgacttcacccgttatgaagaccggcaaatcagataaggcaaattgcgaggccaatcgtttcgcttctgaaaaggtgtgatgttcgccggctagctgataaaaaggatcagtttgttcaattacactcataaattggctccttttggttctaattggtttaagtataacacgtttatgcgatcgaaaatatctttttctcttgtatcggttcatttatttttatttacaaaattaaaataattatcttattgtttgaatattcatgttataatggcatattaaatagggatttaaataagaaaggactctgtaaatgaaaccgttgcttaaagaagactctctcatccaggtaaaagacattttaaaagcgcaccaaaacgtaaaggacgttgtgatacatacgcctttgcagaggaatgacagactttctgagaggtatggctgcaatatctatttgaaaagagaagacctgcaggtagtcagatcatttaagctcagaggggcttataataaaatgaggcagctctcaaaagagcagactgaaaacggaattgtatgcgcaagtgcgggaaaccatgcgcagggggttgcgttttcatgcaaacacctcggcattcacggcaagatttttatgccgtcaaccacaccgagacaaaaagtatcccaagtggaactgttcggaaaagaatttgttgaaatcatattgacgggtgacactttcgatgatgcgtataagagttctgcggaatgctgtgaaaaagaaaaccgcacgtttattcatccgtttgacgatcccgatgtcatggccggacagggaacggctgccatcgaaattttaaatgacattgacgtcgaaccgcattttctttttgcaagcgtagggggaggaggactcctgtccgggatcggcacgtacatgaaaaacatctcgccggatacaaaaatcatagcggtagagccgaagggcgcagcctcctattttgaatcgaaaaaagccggacaagtggttgaacttgagaaaattgataaatttgtcgatggggcggccgtaaaaaaaatcggcgctgaaacctttcaaacgctcgaaaccgtcgtcgatgacgttttgcttgtcccggaaggaaaagtgtgcagcacgattcttgaattatataatcaatgcgccatcgtggctgaaccggcgggtgcattgtccgtgtcagcacttgatctgtacaaagaagagattaaagggaaaaacgtcatctgcatggtcagcggagggaataatgacatcggcagaatgcaggagatgaaggagcgctccatgatttacgaggggctgcagcattattttatcgttaatttcccgcaaagggcgggagcgcttcgcgaataccttgatgaggtgctcggtcctgatgatgacatcacccggtttgaatacacgaaaaaaaataacaaaagcagcggccccgcattggtcggcattgagcttaagcatcgggaagattacggcgcgctcattgcccggatgaatcaaaaaggatttcattacgtagaggtgaataaagatcaggatctgttccacctgttaatctgactttttttagaacggccgcgcaaaatgacagacacgctttctcagattgtatataataaaaagaaaacaatcgaaaaagaaggattgatatcttgttactcaaaagcctagagttcaaacgacaggacgggattcaggtaaaagtgacagaaataccggttatcacggaaggtgaacaatatttttttcaaattcatcagcaccttgagctttatttgagagaagtttttgcttcacaaagtgtgagaacagtgtattcattccgacaatatgtcaagcgccgtatgaagtggaaagattatgaggccgttttcagccaagagattttaaaacataacgcataacggtgcacattccttagcgccttccttttgataagggagggtgcgggaatttttttatgatgaacgctgtaagcgttttatctatggggggaatggaaatgaaaaaaatgaaaagcttcgctgccgtcttttgtttgctgctcttgtgcgcctgcggggggaaaacgataaaagacccgctgaactatcagattgagccgttttcatatcagaaccaagacgggaaaacagtgtcactgaaaagcctgaaggggcatgtctggattgccgattttatgtttacaaactgtaatacagtctgtccgccgatgacggcccacatgaccgaactgcaaaaaaaactgaaggctgagaacctggacgtgcggattgtgtcattcagtgtagatcctgaaaatgatacgccgaaacagctgaaagcctttgcttccaaatatccgctttcgcttcgcaactgggattttctgaccggttacagccaaaaggacattgaagattttgcgctgaacagctttaaagcaatcgtcaaaaagccggagggagaggatcaggtcatacatcaaacttctttttatttagtcggacctgacggcaaggtgcttaaagattatgacggcgtgcagaaggttccgtatgatgatatcctctcagatgtcaaagcggctgaggagctcaagtaaactggcagattagacattttcaaaactgaaaaaacatgttacactttccactagtagacggggaaggagcaaccagattgaagctgcgaatgttctcattgatcgccggactggctttgcttttatcagcttgttctgtccagcgcaccggttctgacgctgaagaaccgaaaacgaaagatcatattgtcatagctgcggtcggtgattcattgactgaaggagtaggagatcctgacggttcaggatacgtcggcaagacagcggagtctcttaagaaaaagggacatgtgaaaacggtagatattaaaaattatgcggtgcagggcgacaaaacgtcagacctgctgaaaaagcttgataataaaaaagtgcagaaatcattaaggagcgccgactatatcttttttaccatcggcggcaatgacttaatgaaggtgctccgccagaatatgatgcagctgacggttcagccgttccaaaaggaagagaaaccttttgaaaaacggttcaagacgatcatttcaaaaatccgcaaatataatgaaaacgcagagctggtgtatgtcagcatgtataatccattcacgtttacgctgcctgaattaaaagaaattaatggggttgtgacggattggaacaagatcgccgcaaaagagctggaaaaagatcctcacgccgctgcggtgaatgttgaagacttgttcagtcaaaaaagcggcagcagacggatttcaaaggatgatgattttcatccgaacgcaaaagggtatgcactcatcgccgaccgattatacggcatcatagaaaaacaagggttaccagcagaatagggtgaaatgatgaaaaaatggaaatcgctgttttttgttcttctcgcactcaatgtgattgccgccgcggtaattgtgacattattggttatgccgggagaacaggcgaaaatacaagatcagacaaaaagtgagtacggctttcatatcacaagctccaaagaatcacttgccaggtttgtgaattcgtacttaaaagagaaggcatcgaatcagcttgactacaaagtggacatcaataacgatgtgcacgtggcaggtaaaatcaaagcattctcaacctccattaacgcggtcgtcacatttgaaccgtccgtacaggagaacggagatgtggttttgaaagtgacgaagttttcattaggtgaattaagcctgccaatcagctttgtgctgaattatatggacagcttttatgaactcccgtcatttgtgcacgttcattccggggataaaagcatcgagatccgtctgtcagaaatgcctttagacaacggcatgtatgtaaaagcggataaaatcaatctcgacacggatgaaattgaattttcctattatcatccgaaacaataagttttcataaaaaaaacacagatcctttcagggatttgtgtttttttgtgtcagcgttttttgtctagcttgctgaacagtttgattaacgttgcaagctcttcatcagagtagcagtcaaaccgtttaaaaaagtattctgtttttttctggttgaaatgatcgacaattttctccccggcttccgtaatatggattctgataattcgcctgtcctctttagaacggatgcgggtgatccattccttttctactaaagcatcggtcactgcggtaatgtggcttgcggagacctcaagaatgggggcaaattccgttacttttttaggcccttgttcactgagaatccgcaaaatggtgaattcgttcctggacagctctttatctagaatttcattaacttcatttctgatttgtttaaacacttttcgaagcaaagcttccatatcatacatcatttgtgtccttactttcaaatcatgaacctccaatatgtagtcagcgtggcattcgttcagcttctcctgagagcagaattatttttattctgtttatacatgctataatataataataccacgtatgaacaaaggagggcacccgtatgtcagaaaaaaaagaaatcgccacatttgcaggcggctgtttttggtgcatggtgaagccgtttgacgaacagcccgggattgaaaaggtggtgtccggctatacaggaggtcatactgagaatccgacttacgaagaagtgtgcagtgaaacgaccggacacagagaagccgttcaaatcacatttcaacctgacatttatccgtatgaaaagcttgtcgagctgttttggcagcagatcgacccgactgatgcaggcggccagtttgcagaccgcggaagttcatatcgggcggcgatatattaccataatgatgaacaaaaacaaatcgctgaagcctcaaaaaaacagcttgcagaaagcggcatatttaaaaagccgatcgtcacagacattttaaaggctgagcctttttatgaagcggaaggctatcatcagcacttttataagaaaaatcctgatcactacgggcgctaccgtgtaggttccggacgtcaaggctttctggatgagcattggagggacagataagatggcttttaataaagaagaaaaaatcaaatcattaaaccgcatgcaatatgaagtcacgcaaaacaacggaacggagccgccgtttcaaaatgaattctgggatcacaaagaagaggggctgtatgttgatatcgtatcaggaaagcccttgtttacatctctggataaattcgattctcattgcggctggcccagttttacaaaaccgattgaggaagaagaggttgacgaaaaactggacacaagccacgggatgatccggacggaagtgagaagcaaaacagcggactcccacttaggccacgtatttaatgacggcccggggccaagcggtctccgttattgcattaactctgcggcactccggtttattccgaaagacaagctgaaggaagagggctatgaagcctgcctgcatttatttgaaaaatagagctcagcaatgaggcctgcctatcagacaggccttttttctatgtttttttttcttcatgtaatcgttcaataatctttacgattgtttcttttgtgatgagcggcgcctgatccgattgatatctggggagattgaccttccgaaattccggatgtttggcgggatccggcaatatcgcgtaaagattgccccattcatataaagattccgtctcatgaggagaggtcagttcttcatgaagcttctcaccggggcgttttcccacttcaacagcggctggctgcggcagtccgtgccggaacgcatattcttcaaacccgtgaagcagttcttcaagcctcagggactccattttaaaaataaacgtttctccgccctttgtaatcgccgcagattgcagggtgagcgttgcggcgtcatcgatcgacataaaaaacctcgtcatgtttttatccgtaatggtgagcggaccgcctgccatcaactgctcaaataaaataggaataacggaaccgcgtgaaccgagcacattgccgaagcggaccgaacaaaacaccgtaccgcggttttgaacatgatgattcgcctgatgaaacagcttctcggacaacagcttcgtagctcccattgtgtttaccggggaaacggctttatcggttttttaagacatttactgcattttgaggaactatcagtggcggtgagatcgaaagcgtaaaattaaacttcaggataggggtgatttcaaactgagccggaattggcccttttcttttttgtgtcatcgtaacgataacttctttgaagaccattcttaatagcgagttctttttttctgtgcttgtttcaatgtgatattgatcaattatcttatttatgttgtttctgactgtattactgtctatttctgattgcgcttcttgagttccattgagttcatgcttggcaatctggagttctttaaattcttcatctaaaacagcttttcttttcaaaaaaagttcatcagtgtaaatgccgctttcatatttctcgaagataaaattctctttgttttttaactcttgttctttttgtgaaagatgttcagacatttgcttctttgttttcacattactatttacgtcttcgtatttagaaatcatataaatgatatgttttgttaaagtcttattatctaagttgcttaaagaagagaggtaatccagaatggcattttcaacatcgttatatctcacataagtgcatttattctttttgcaagtgagtgatttaacgtgatacacactttccgtgccgtttttgttttctcgcgttcgcctagtttcgtatttagataatggttcaccgcacttagaacaagtgcatacgcctgccaattcacttaattccaatgcgtttttattaggcagcaggggaactttgtttgcaattttctcttgtgattgttgaaattgttcttgatctattatagggacgtgtgcatccgatactataatttgttccttttcaggtctaattgttcgtttaccgtcttttgttttttccctaaccttatatttaacagttccgatatacgcttcgttttgcagaattgctttaattgtgtattgattccagcgcttttttcctgatggagtcggtatttgtaattttgttaagtgagaagcaatcgctgtataactaacttcttttccattcaacccatttaaaaagatgttaaagatgaattgaacgacttttgctttttcttcgactgggactagtttggatgtttttttgtttaaccggtatccataaggcgctagtcctgaaatccatttcccttgtgccgcatatgtgtatttagcgcctgtcatacgctctctggtcatttcaaattcttctctggccataaacaattcaaaacgaatctgacgcatgtctgcaggatttcgagggtcataaactttatatggtgtaatgataatcaatcgcttactttgaagaaggttaacaatttgtcccgcatcactgtagctcccgcggctgagtcttgttatttctttaacagcaattgcctggtacttgccttcctcgaggtctttaagacattctttaaaaacagggcgaccctcaatgctttctccagatccgatttccatttttaattcataggggatttcaatcgacttcagtattttattcatgagttcattttgttctgttagcgtatcttcgcctgttcttttttcccgctccatatcctgacgagagcgtctgagataacccaaaatatttgtaatgttgtaagaatgaacgatgttttttaactccaaaaaaacagcacctcctctttattgtatttactgtaaaaacagaagtattcgtacaatattctgtctgacattgaatacgagaataacctaaattctgaagatgaaacttttctcgtccagttgtcaggtgcattttgtaattatgaaaatgataaagcgaaagaaatgaataaacaactattcattaaccgatacggtgaagagcttggaattagctccattaaaggagataatcgatcagaatatgaagaaattattcgtacttatgaaaagaataattacaagcagaaagaaattaatatagatgagctgctgcaggcattatttgagacagagatgatgttatctttaaaagaaaagttttgataaaatcctaattgatgtatcataggggtttaatcagccactataggccacagagtccctcacacgctctgtggttttttgtttagattgaatgtaccaaataaaaaagaagcctcagaggacttcaaactggctctacggataggatagtaattaaaacagcaaataacacttacattttgttcaccacaagtgctgcttcaattatgaataaaattgttactgattaacaaattcgtatcctcagtaattattctgaggagtatgggggtgtttttattgactaactttgtccataagactatcaatggtttgaaaagtcttttagatgaaaaaggggctattaaattgttttgttctgagggatatattgtagagagccttgtgactttttctccaaacaaagcgtctcttagtgaaatccaaaactttcagtcgaatcataaattcactcttcctgatgattacctgaagtttatttctcagcataatggtgcgaaaattttcgaaattctttcagagggcgagaatattggaggaggtcttcatctatttagccttgaagaaatagaagaagaactaaaatacgagcttttgtttgaaggtatcaatggaatacctgtggctacctgttggaagaatgtcatttaatgatcgacaaggatagagtgaatcaaggtgatcctaattatctatttatatttgaaagtggttcagaatataatccattaaatttaaactttgaaatatttttagaccgatatattatgtcgaacggggatgctttttgggactggaaatactatacagctgaaaattattacaggacgagataaaactgtgtatgacagtcggaacggactgtctttttctgttaatcaaataataaagctatggtaaaatttagacagaaagaagcagaaaggagacgtaaatgaaagtatttgaagcatcctcgttaatttcagtagcggagaaacgggcaaaagaatacgatcagattagagaacaatttatcaatctcagaaaagcgtttcagggaatggctgatttagatgacaatgagttttcgggcaaaggtgctgataacatcaaggcattctttcaagatcacgcaggtgttacagacagctggcttgatctgatcgatatgaagattgcttttcttaacagtatttctggaaaagtatctgatgccggattgaccgattcgtttgtggaagagtcatttttagaacatgaactgattaatgcgaagaataaatcaaaagctatcatgcaggagcagcggaatgaaatgagggatattcttaatgagataagcgatattgttcatcttgatgttttctcgacagaggatgtcgatcaaaagctggattcagcagataagaaacgggacaataccgtacacaagctcggaaagctcgatcatgatctaacgaaggaatacgcagaaaccgaagcgaacgagaatttcatccaagcagactttcaacagctccaaaatgccacgggtaaagggaaaaacgcaacaccacttcactataacgtcaaggcgtacagagaaagtgtcatacataagaaaaaaggcgagattgcaagacattcagatgcttatttgacgattaaaaaagaagaagcgaaagagcgagaaatcaaggatctgaagaaaaagctctctgatggagtaactgatcctgatgaatacttggagattgccaagaagatcggttacgagaaccttgaaccttcccaacaacaatatgtgatgcagcttgaacaagcaaaacagatggaagaagccggagaagtgacctgggatattttaaaaggagccggcgtcggcctttatgatgtcgggaaagacacggtaaccggtttgtggcagctgatcagcaagcctgatgaagttgttgaaggtatcataggggcagttgcccatccaattaacacgtataatgccatttcaacagctattgaggaatcgtatcaaaaagatatggtgaacggggatgcttactccagatcaagatgggtgacatatgcggtcggttcagtggctgtggctgtcgtcggaacaaaaggcgcaggagccgttaacaaagctgatgcggcggggaaggtcataaacaaggcaggacaggcaggtcagaaaattaaggacattaagatttcagatttgcttccttataacactaagtatgatcttgctctggctgataacgtaccatacaatgtggttaacagccaaaaccttaaaaatggacttttgtccagtgcaaagaaattggatgaaagcagaaagccatttactggtcagaaagtaaatgtcccttggttaaataaagagaagtatgaggcctatgaaatagacggcaaggtaaaagttaaaggagagcctagagatgtaagccgtagagtatacacaatgaaagatattgaccttaatcaaaaaaatcgtaaaggctttacgaatcttcaactgatgaaaaatggtaatgctccgtttgctaaagatggcacgcaaataaatttacatcacttaattcaagaagagcctggtactatgctggagatacctgaaagctggcataataagtacagtgatgttttgcatggattaaaagggaatggacagagttttagaaatgatcctgtgcttgataaacaatataaaagtttcagaagaaggtattggagatggagagctcagcaatttgagaatcaagaataagaggtgaaagtttaatggattattcgaaaataaaaactttctttgatgaaaataaagaaaattcaattctcacggggggagtcactgaagatcagattagagaaatagaagaggagctcaatgtaactcttccagacagctataaatggtttttaactgagtatggttcagggggagcatacggaacaatgattctcggatatgactctcacggcgctgaagttgtcgagcagaccaatgaatataaaaaatattataacctttccgatggtcttgtagtgatcgaatatgtagatgaattttcttattgtcttgacactaacaagatgatagatggagaatgcccagtcattctttgggataaccaagagggatatggtaaacaagttgctaggacattccaagagtttttaatagaagagcttgaagaatcgaaagacgactggatcgatgatgaggactgggacgattaaaactaaaaagaaggtctatatctgtttttccatagcatatgaaggagtattaaaatgagcttcactaagatcaaacaaaagttgaaagagtttacgattaatgctggcacagatcctagcattaatacaaacgagcagctcaaagaaattgaaagaaatataggtaatcaattgccttccgactataaggattttttgaagggatatggaggctgttatttagaaagtaaaaaaacaacagatgaggttgagtatgacgtttgctacaaacctatagagaaagatccttggatgggtcaggaagatgatacacaattaatagagagcttctatggtttagctaacgatcataacagtctccaagaagcaatcaatacttattctgatcgctttcccaggaacattattcctatagcaagctcggcaggtgggaatgaaatatgcatggatatcgataatgaaaagatattgttttgggatcatgaattaagtcaccccgataaagactttttccttattgccaactcttttgaagagtttattctaagtttagtagatgaaccaattgaaactgataataatgacagtgatgtggaaattgaggttttagacaatgactttgcaaaattgctctttggtaaggacaattagcttttattgttaggaaaagtattgcaaagttaagctctcagaaagagagcttttttattttcgatagaaactaattataaaaagggagagaggttatggattcgtaccaagtaaagaaattaaaacccgaagaataccataagtgtaataatatttgggacatggaaaagaaaaagaaaatggctaaggtgttttatgacgaattagtaagcggaaacagaattacttttatttactcagtgaatgacgagtttataggagaaggatcgttagtttttcaaaacaatgacccagattataccattccggataaacgcatttatctgtctcgtatgattgttaaagaaggatattgaaattgcgggataggcggtattattgttgattatttgattgattatgctaaacaacttggatttgaggaaataacattcggtgtagatacagataacttaaacgcaagacatctatatgaaaagaagggctttacaaccgtattatttcttggtgaagatgaatatgtaaaactccttaaagtattaaaataaaattcccgagaattatggtgaatgtgtgggaggttactttcacaaacgatgatagacggtaacttaagctaatctaattcgttattaagatacggattagcatttatcctctcaaaaccaacccgtaatgaactaggatactgttggctgaggaattatttttccatgtattgtattttatggtattcttgaaatgaaaggaggagacaatgaaaaagaaattaattggggtcttgatcattgtttgtttttctgtgttcatgtatggcgcagttacacattcttttaaaaatcaaaaatccactgaggaagtattagaaagtgcatgggatgaatttggcttatttagccttggaattggagaaacagacccagtcatatcaattggtatggataaaacaaaaaatgaagaagaattacgacgctatctaaacgataacttatctaaggaagttaaagaagaatataaagttgagatcattaaaaaggatattaaggttttagaaagacaacatgagaagtatttggaaagtaataaagcgcattgatacattaaagatgcttatcggctccaaatacaataatgattttatccaataaacaaaagttttgcaaaccattccaatggtttcatttaatctgttataatcaatctgtaaaatacagactggttatagtgtatttctttaacaagaaatgcataaaataaaaagagcatggtgttggtcgcaacccatcaaagggcttgctcagatgttatgttattcatgatagacctaacccttcaggttatcaggctcaagggaggtctattttttatttatatacgtcaacagggcgattataaacgacccaaatgcaagcattcacattaatgcctgaaatgttgacataagcatcaccccctttctatagggggtgagcaagactccaagactccaagattcccttaagtgagcatacttaatgtacaggaatcatttatatgtcgttaaaaacccattcagttacctatgcgaaaagaaccatgttagaatcaggttcttttttgaatttgagttaaataatcggctggaattaccgataaataacatgtgaaataataccaaggaggttaagggattgaaaaaagtacttagtttagtaacaattacacttcttgctgttacaacgatgttttccattagcacatcgaaagcaaaagcaattgaagcaacaccgctttacagtcttcagattctttccgtcacatcggatggaaacgactttgtatgggagcctgttacaagcagcaagccaaatgcaacaaatgttttgaaaggtgacaagctgcatattaaagttcgctttatgggctatacaaattcgaccgtcattaaagcaaaggatgggagaaatttgttatacaaaggtgaagcgaacatatacaaatatgaccctatacttggacaaaacaaagttgtgataggatgggacaaatacattgaaattccaatgaacgaacttccttcaaatgagattcaagttgaaggtcttgggaaaaacatgaaaatcatttatagcaacgttgtaaaattcgagagaggatgaatgttatggaaggtctaaataactcttacaatatcacgaaagatccgaaatttttagcgttttgcagtttagcgacagaaggtgcaggaattagttcgaatacgcaatgttcaattggttttaatgaattcaaagaagcgctggagaatggcaaagtagttgataataaaaaccttaaaagcagttcagagttaaatcaccagtttgattactggaagtccagaataactgggggacgagctgtaactgaaactgataatcaagtgttagatatcatcaaacaagcatacaatcttggaatggttacgaaagataatatgcttttgagaaatcaagccattaacgcgtataaaacatctatttaatttaaaattaaagccccttattcaggaaggggcttttgctttgcaacttattctttatgtttaatctaaaaccataaagtcctgcacttttgtttcttcttcaggcaaatcaaattcattaagtttctttttagtacggatatcaaaaatccccatatagccaccaatcccttttttgttttcctcttgtgaaattacataaagtttttgatctttaaactttgcattcatatacggaaattttaaatcgaatttttcaaaagaaaaatctttatcgtactcaagtaagcaggcgtatacggatttattaatatatgtaacgtaaaatttaccgctttttttgtcgtaatacacagcgtccgcttgttcgagatcatcaggatattttatgaattttgatttccatgatcctttttcgattacagttagttcatgttctgagctagctacaacatatttttcagagtgatcaaatacatctccataggaagctaatccaatcgttttaataatcccttctgtgtttctatcaatgacgtacatagacattccttgaatgacgtaaatatacctattatcgcttcctcccatggttacgagggtaggcaaagtcaggctatattttttattgaactttttatcatttactttcagttcatttccattggtgtcgacattataggcttttacagaaatatcttctccttgataccaaaaagcaaatggattggataatttatgttctttaatagtgttgttttttaatgtgtaataatatggttcatgttcagctaacaagacgatatcgtctgaagagggggtttttttctggatatatggtatatccggtaccttaaagtatcgtttattgaatttttctccttgtgatgtggatatgagtacgcttttcttgatgagtggatttgaatagataaaaaagattttatcctcggttggatttattttagaagtacttacagagtgttcacctttatttataaagaatgcattgatcaacaatataactattgcaccaattagaactcctgaaatcccatataaaacataagactttttcatataacgctccatatcttttatataaaaaaacacacttgcagaataaatctgcaaagtaaatgattaggagcagacagtttttgatgagcggtcaatatccagatgtgacaagtgcttctccattactgtttaggtctgttccttttgtgtttttgtatgattgccacacaagtttagaggagcaatactatttatttgtgctttttttggttgcagctatgaataaggcttacctgttttactatgaaggacagcattgcatagagctttacaggtgaacacagatcataaaaaaacaccccctatgcgggagtgccaaaacatttatgcggtttgccctctacgttccactgagaagtcattatggtgatcaagcgcgatatggatactggctgtgtggcctcttcgggcttctttaaaaactttgtggccgtcaagaagataatgtccaacaagcccaagtaagataactaaaaagataaaagccgatgcaaatttaaatttcataaagacaatcccctctctgaatttgttttcgggcataaagcactttctcataaaaggctgtagctactttatggtcttcatttacattataatacattgctgcatcagtcgctaggtcttccacatccgaaagcatagcttttgattctaagtaatctaagattttaaaaagtcgttctttgtcattctcaacgaataaacccataagaaaatcaaacatttttcctaatacgtcatcgttcaactcctttgaaagcataagaccttgttcacaaacctgttttccatcgaccgtgttgaataatttaaagtgcgtttttgccaacattagaagtatgtcaagcagtcggctagaattgtgaagagaattactttgataaattgagacgccttctttaaaatactccaatgccttctccatatgtcctgttgtaaatgagcataaaccgagattgtacaaagaagaacctattaaccgcggcatatcaatttcttgtgcttgttttaatgcattcatgaaatgcggtattgctttttctggatactccatgtctaaataattcagaccgatgacgaatgaacattggattactcttattgagtatgtctcgtgtgctttgtaggtttctattgcttgaacaatatgatgcatagacatgtgggtttgcttcatgtgatagtacacttcagcaactttgtagtgaaattcagctcgctctatttcatcggggacaatagatatcttcttttcagctcggttgtaaaaacttattgctttaagatattcgtactgttcaaattcatacatcccatgaaaaaagttaaaataatattcaagaattccttttagatcgctttgtttactttcgatctcttctgataagtctgaaattttaggtcgttcttcattcatggtttttggttcaagataatcaagcattaattgatgtcgaaaacacatgagcgaatagtacaacaataaatcttgatcttcttccatatgctctatttcttgttcaacttcaccctttagaatttctgcatctgcaacactgaataatcttatgtatttgtaccatttattgatttttaagccaacctttgaagaagagatcaattgctccaaaaaaatcaccctcctagtatttcgactgattatgtaatattttatcataatgtaatatattaggaagagtgttttttcttaatttctcaatttggtgtggaatgcgatagaagccccctcgttcgagaaggggatatgatcaatttcctgttgctttcagtgaggcaagccactcatctaatgttccggagaagccttgttgaacggctaattcatatgctgattttccatctttaccggcagcgctagtagcttcagtactgcctttttcaccttttttttaatgaagctaaccattcaaaagtgatgaatattcaaggcgggagtaaggaaaattaacaaaaaatgtgagggaatttagatgaaacgatttattttggttatacctttattggctgctgttattgtctctccaactcaaatgaaagcaagtccaatgccttgtagtgcagtactcgaaccggtgaatcaaaaattgaaaaatgcgaagggtgcggcactaatctataaagtgcagttatacccgccaagtgctgcgagaacgaatatgagtattcttgctgtccaccttcctcagccatcttcttatggaagctacgacggttatgaaggatttgcctccaaaacaggggagatcagttggcgatttaaactatatccgactcccgagggagagagtcctaattgggctggaaggattgattccatatcagctgaagtgacaaatgttcaagtgcaagtacgcctttcaaattctaagacgcaaaagttggggccgagtgtattaacaaataatattcaatcttgctattagaaatgtagagctcttatcaaagaaagaaatgcgactggatcttttgaaaaaattctggtgaaaaatgaagaagagtccattaaggcggagtccaatgaatgatgaggaattaagaatcattctgaaatcaattcatcattgacagaacagagccggcaaaagtcgatattgcgtttgattttgtacaagaaagacggcataaaaagaaatggttagctaaaaaaaggcaaagagtcaacgctctttaccatcaggtgttttccttaagcggtctgcaatatgcttaattaaactcagcgcagcagtcactaatccaataactaaagcaatctcaagtaagaggataattccaaaatttaaaccgagactttcaaagtaatcaccagtaaaagagagcaattgataaatcccaagcatcagcacaataaaggaagcgcctataatcgccagagactttttagagaactccttagtatggttaaaattataaaccaataagaacaaaaatagacaagccatggcgatcttatgagtcaatgaatcacttgctgaaaacccttgcacaagtaaggagataattaatccggtcattccgattattttgttcaatatatcacctgctttgtataagtatgacttagatgtcagcttaccaattaaaggtgaaattctcaacataatgcagtttaaagttaacttaaaatgtgattattttaagaaagaggttgaaatatactcgattgtcaaaaaggggagcaagtaaggtctttgagaatggagaaatgggaattatattgtggacgacaaatcgaggttctgtaggtgttgaatgggactctggtgaatatggtgaatacaatgataaagtcgatgagctatttgttagcagattaatatgttttccgaaagttagacgaaagcagttcattaaaggaagggttagacaatgattaaaataacgctattccaagatgaatattgcaatggtgaatgggttgaaattgataggctattaaatatatttataagaacagagtcaattaatattgaagttattgatatcaaatacaattcactaaatactgtgcgaactcaaatacactctgcgtatatatagagaaaggacttaagatcactaggaccgaagatgaaatcgtgattttaaacgtagtaagaggaagaaatgaaaacctatgtagcaaccaaggaaactgagtactttaccaatgaatccattgaagaggtgctttatgctggtacaataaagaagctgcgtttagcaaaattgatggcacttcaggcaatagactaattttagatgtttgttttgatggcttgaggattaaatcttttatcaaaattcataatggtgttggcgagtagcttttgataaattggccagcgcaaagaaagaggttgaagactacaatgccaaactaattgaggcaggcacaatctctttgaaatgttggagagagctggacaagtctagataaaagatagtttttattcaaatactcaaggcagagcctatcgcacctacaatgccaacaaaatcaactagtgttgttacgttgctcataaagtcaaaagaattgtttattagaaacataaaatcagcccctgtgaaaaaatttaacactaagataaaaaataataagaagaaggattttatcactggcttgttttttgtgtaggagcagccttgaatattcgattgtattactaatatatcaaaatttctacaattaatccaattctctcttacgatagtttttaacgaatacaaaaaagccccacgaatggagctgctagattacgtattattgaacatagccagaaaagtcgctcggagcagagaaagatagatagtaaagcgcattggcatctagattttttattgttcctgtagctgtaccgttagcatttacagttagtgtttcagtagcaaaaatccagtcggaatcattccaaactttcacagttagtttagttccaatattatttgtaattgaatagcttatcgaagatttgccttgaaaataactgtttgaatataacgtattgccagttgcttgtccagcgaatgtcaatttgtttttcgtaagatttacaacgctatttgaattaggagggttaagaccaaaagctttaaattcactttcgacagagttagtaagcttagttgaaaacctagaattgtcggtctcagcagatgcggcagtggcaatgctcagagaaagaatggccaccatggtgcaaacaataaaactaaacaactttttcaaattaaacactcctttatttgtaagttaaagtaaataataacatttaatttcaggaggtcaatgggtttattcaaactggaatgaatctgtcacaaaatatgaagagcattttggtgaattacagctaaacgatttggataacttattgtattatgtactgaattttcagtctgttttgctaagcattaaggagttatgtaatagagagattatactctccaagattcaaaggaaggtatgcggagtttaccatgtagtcttaaatctataatcactttcagccagctataagaatgtttattaatcccatatggagagttagctttattaatacgacgattccttcaagatgcttttcattggcagattaaagtaagctaatccgtttccctgcagaccttcaataacaaatacattgttatggtcaaggttaatgtctaaaagcatgcttttccgttcagtgagcgggttattagcaattgaatgccaattaatataaattatatcgactacacagtaaacgatattataggcagattttttagacataaagcgtcccattacagtctcaaagtcaggaagcaaaaacaacagtaccattgagcatatcaagattcgagatttctcaacttgcttgttactttattgttgtaaacgagtataaagctggaaggttcagtgtagctttaggagccgaattgcttagagaaagcactgtatgaagagggattttaattaaataaagcagacattaagcctgctttatctttttgaacattattccttttttatatgaattaatgttctcaccaaatgcccgtccttaagattttaaattctgggcacggtcagactttttagggaaaatacattctaacaaaagaaaaaataaagttaatcctaatgataatttaaaattgtcgctgttcccaatggaacataagatacccactatataaataaataaaaacctaaacaacgaggcaaatataaacttgaagaagttatccccaatgagatgccttccaacagccacaaaaatattatcaaaagtaaaagaataaacaaccatacacacacttgttataacaatctgtttaaattctatttctaattcaaagaattttacaagcacatttgctgatcctgttgcaaataagattatcaccattatgattgcagtaggaatgagtgataaaaccaaagctcctattactgtagataataaaaatttttcatttgtgtttttttctgcagcttctttcttttctcctctgtacataaaaataaaaaagacgatgagagataaaagataaattgataacgtcataacaagcagattcatggtaatctctccttacctaattaaaacaaaagagtgaaggttgtaagcctcactctcttgtttttaatgtatagttataccaaaaagaacacaacaaccttcgcaattaactgtgcatcagctaatggaattccggctttcactaaggccacagtaacagctgtttctccgaaatttgtaagttcatctataacgtccgccgctttgtgtccccacttagaacaagcatcaccagctttttgtgcccatttatatgggatctttttaataaggtttcctaaagcggggccaccaaccctaagtgcttttactaatatttgtttagcgaaaggaatgccctgtgtatgtacttcaggatttgaagctaaaggagcctgtacgctattttgaactacaggtgcttttttactttctgctgcacttgcatagccaggagaaacaactgatatagccagcacagccaacgtgaacaccatgataaatgaaataagttttttcttcatttcttcaccatccttaaataaccattagtttaatatatttacaaatataatggatatttgtaatgaaatcaatatattacctaaaaaattttagttataaaagaaggaacaagaattttaaaaacatacttttgttattatacgagacacaattttcttaaaaaagaaccgaaagtctcattggggatgcccattttatgccgtggagaagattcaataaaactgtaggtttaacaaaaacaaatattttcaggagtgtaatatcataaaacactcagagggggaattaggtttaagaaacaccattggcaagattgaaattgttggaattttactggagtggtttgctttatgattttggggcaggagttaaggcgaaaagagataactcagacttggaatgatactgaaagcaacgtctacgatcaactttgacaaatactcaactgctgctgtcgttcaaacattaggatttgcttttaatttgcctacagggggctggtcatctgatttagctggattagctaataatgatcattctaggtgaatataaaattgtttacttttaggataagcaggaatgtaagatggcagggacggctcttatgacaaaacaccttgtaacgatttatgaagataaggatcaaaagaaaaaatcgggagtgacagctttatcatcacagacaaaggcggcccaaaagttgctgcaatgtgataaaaaataaccctgtcttaggcgggggattattacatgctgtttattatgctgtaaacaaacgcaacaataaataatggataagagataatagcaattagttttgaagatttgctctttttttcaaatgtgtatattagtgcaaatcctaaaaagaatattgtgacaaaccaagaagaataggacgggtacaatgcaataagtaagacaataagagtggataacgcaaaagaagagtcaagtgttattttctgatcgtttttcaaataaaccgcctccttacacatattccacattagatcgcttaaagaaggtgttgtggttgatcagccaattaaatatttcatgatgcaattgtgcggttctatgatggtaaagacctcgccgtgttccataagactacggggaagttgttaaaatccttaaaaatgagtcgttttagtctgtcatttcctaaaacagtgttttactcttgttacaaatatgcaagaagggcggtttgaacttgtatagattatgtacaatgctgttaattttgttaagtataacattagggtgtcaaaacccaaagcaaacattttatggaggctgagcaaaccatggtcggctatgtcattttaaaaggagagaatcaagcaattttcatacataatgaaaaagctaatgttaaagactatgaaaatcttagtgaaaaagagattattaaaaagtatagatcggatatagttttactgggacttagtcaacttaacaataaagatgacttgagcaaaggacaaaaaattcgtatttggtataaaagattcaatgaatcttcaccgccaaaaacaaatatctcaaagtttgaaagtatttagtatttattctttgattcccagaaaaccgctgcaaaactgaagcggcatattgaaccgaaataatgtcttcaaacctcacgtcattcttcattcgcggtggcttattcctgccccaggatttatttgacaattgttgactcaggtgcagagaaggcatatgtcaagaacacattttgaattactgggcaccttgaataaagccagcattcccatattcatatgcgaagagatcggtactgaacgctggatcatacatttgaacaagcttgcgaggctttgataaagaaagaacagtcaagagacgaaccattacatacatataatactcctgtgaaagcgggggtgtagttttggaaccttaccaacgttatgaggaattaaagaaaaaaacaataaaggttgtccataaagataattacagtatccgctatatagatcaggatgaagcgagtaatgacttagatgaattttataaacaatttgctcagcatttattggaggctgctttggaaaggagtgcagagtaagcttctttttttgatttgtttgtggtaagtatcttaataaacggctttatcagtactgatattaatcacatgcgtcacttcttgcagcaaagccgcttctgcgacattttgtccgccgataaggttggtttgaatggcttcaaagggattatcctcacatgtcggaacctgcttcagcgcagctgtgtgaaagacaatatcaacacctttcatcacttggttgactcttctgtagtcacgaacatcgccgagcacaaacgacagtctttgttcatccgcgtatttttgcttcatcacatattgtttactgtcatctttgctgaacacaatgacttctttaggggttaagagcaaaaggcgttttactatttggcttccgattgatcctgttccgcctgtgacgagaacagttttatcgtgaaaaaacggttgtagctctactgcttgctgtttaggcatggcttatcctccaactctcgtttctctaccatgcatcatatgttgaacaatttcagcgagttaatgaaagaaaccaataaatcaaaaattagagaaaaacattaatctgatgcgctttcatatcgcgttacccgattaatagaatagaaattacaaataaaacattgtactaaatattcattttaaatatttgctcacgtcaattttttctcttcataaatcctcacattcggacaatcttcacaaaaacttaacactgaacttcctgtatgtattttacaattaaagtgcacgttcataaaaggaggatggaaaatgaatcattcaaaaacacttttgttaaccgcggcagccggattgatgctcacatgcggtgcggtttcttcccaggccaaacataagctgtctgatccttatcattttaccgtgaatgcggcggcggaaacggagccggttgatacagccggtgatgcagctgatgatcctgcgatttggctggaccccaagaatcctcagaacagcaaattgatcacaaccaataaaaaatcaggcttagtcgtgtacagcctagagggaaagatgcttcattcctatcataccgggaagctgaacaatgttgatatccgttatgattttccgttgaacggaaaaaaagtcgatattgcggcggcatccaatcggtctgaaggaaagaataccattgagatttacgccattgacgggaaaaacggcacattacaaagcattacggatccaaaccgcccgattgcatcagcaattgatgaagtatacggtttcagcttgtaccacagtcaaaaaacaggaaaatattacgcgatggtgacagggaaagaaggcgaatttgaacaatacgaattaaatgcggataaaaatggatacatatccggcaaaaaggtaagggcgtttaaaatgaattctcagacagaagggatggcagcagacgatgaatacggcagtctttatatcgcagaagaagatgaggccatctggaagttcagcgctgagccggacggcggcagtaacggaacggttatcgatcgtgccgatggcaggcatttaacccctgatattgaaggactgacgatttactacgctgctgacgggaaaggttatctgcttgcctcaagccagggtaacagcagctacgcgatttatgaaagacagggacagaacaaatatgttgcggactttcagataacagacgggcctgaaacagacggcacaagcgatacagacggaattgacgttctgggtttcgggctggggcctgagtatccgttcggcctttttgtcgcacaggacggagagaatatagatcacggccaaaaggccaatcaaaattttaaaatggtgccatgggaaagaatcgctgataaaatcggctttcatccgcaggtcaataaacaggttgacccgagaaaactgactgacagaagcggaaaataaacatgaaaaaagcagcttatccaagctgctttttgatgtgaagagcgtttcatgagaaagtcttggaacggatagccgtaagcacagccggcagccggtcatacgtgtacgccggtactgtctcttgataattaagcgccgcgatttgtttacgttcacccgggtttgtcatataaaaatggatcttatccgcaaaatccgcaaacccgctgtaagaaacaaatgttgaaaacgggggcgcgggagaaaggtctgtcagctgaaaggcctgacaagccgcaatgtctaagcttctcgtatttaaactggtattttcgatgccgcgtccgttctgattgagcgcaaaccgataagaacggtgagggtttaagaccacctctgcgctgttgtaatataatgcggcaagttcgggttcaatccattcatccattacgagcacattttgctgtctggcgatttttttaggcagatgtctgcgccatcccttcccgataatacgaagcgtatacggaagcttcgccgctgctttcaccagttcaacgcggttcggatacgggtatccgatcagaagcagatttgtgtgaagagaggcttcagcaggttgttttttaaaaagccgctgattaacggggatcgggacataatatacgtgctgtaagcccatttgccggtaagcatcaagcgcgttttgttctatcgttaaaacggcatccgcaagcggcgcgattgtcatactcacatcgaaataaaaaggatcctccgtcatccatagatatacgggaatctgttctgtcttcagccattgaagccattcagacggaatacggtctcccgtcatcatcagactgatgtctggtttgaatgcccgtatactgcggatggtatcttcctcaaactcagaaacagaaaaaaagcggacggaagactgtaaaaagccttcctcgatccagcggtcaaaatacgtgtatatgcctttatatcctgaacggatatataaaacgttcatatgctgttacgaagtgaacgtgacactttcaactttgtcgacgtcaagcaatgttgtagcagagcctgccggtgtaacggaattttcctgcgtaacaaaaacgattccgtgaatttcgtcaaaggcaacaaattgaaccgggccgatcatgtctcctgaatccatcacaatgctgatgacagtgccgggctgaattcttgcaaaaatccatctcgccgctaatgaaataccgcttcccaatacagattgtgcgctgagactgtctttcgccgctgcttcatccacttttgcatcaattgccgattccaataaatcttttactttgttttccacattatctcctccatctgtgccgccagataaagcgctgttgtcaaatacaggggctaaaagagtttttaataacttctttttaagctccaaacgatcctcgctcatgcggacatacacctcctttacaatttcaacctcacgtttattcatattcctgattgaaaagattggtataagtcgaatgccgttttgcttgcatttttttcaataattaatcaaacagctgaattttcgaatcaggctttgtttgcctatgcggattgtaagagtatgacatacgttgtatagattaaaaaatgaaggagaggaatattttggattcaggagaaactgtaaaacacgggggttttgaggaggaatttcagctcgtactgcttcttcttcttttgttatctcatcagccgtccggagatcattcagatttgcggcgtcagcttgtaatggcaaaagagcttggggttcctgtgtcgcgcgtcaatctgattaacggcagcacactgcagaacgtaattgtcaaagaagtgctgtcagatttggccgtttttcaaaatccgctcaataatacgagatcaaacgtcgcgatttcaagcatcgtcagctggggggctttttaataacgatatcaggctctgtctctttcggagccgttttttacgttttacagaaggggtgatgggatggaaaagaagatctcaattatcttaacgagttacaacaaaccggatcttgtaaaacaggcgattgaaagtgttttgcatcagacctacagcaattgggagctgtttgtgatggatgatcattcaaatgaagaaacctcggccgccatcagtacgtatataaaagatcatcgcatatattatgacaacagttttatcaatccggccgaacggctgaagtcgacccggtatgccgttttgattaatgatgcgctttcacgggccgaaggcgaatacatcacttatttgacagacgacaccgtatttcatccgaataggctcagccgcatggcggaagcgcttaatcaatgcagcgagtttgatgccgtctattccagccagaaggtgatacatgtaaacgggcgcggaacagaacaattccacttctatcgttttgctgaagaggtgcttgatcaggccgcttttctcgttgatcactgttcagtgatgcaccggagatcattgcttgagcgtgtgaaagagaagttcggcagcttttgggacgaagatgttatgcattggaatcacggagactctgttttttggagcaggctcaacacatttacatcatttctgccgataaaagaagtgttggatacgacctataaaacaccccactcatttcagaacacgtatcaatcgcttccgtctgtcctgatcgacggatcctttgtaaaggggacggatcagaaagtatatcagcttgaccgaaataaaaggaagcctgtaaacgagcgctggcatacgttatacgaaggccggaccgtcgtcattccggatccgtttttatttcaatatgaggaagaggactccgccagtattccgaattttcagctcgtcagggatcagtttcatgtttattttatagaagacggggagaaaaggctggttgatcatagcgcatttcgcttttaccgatttaaacggcatggcatcccggctttagaacgggccgaaatacaatcgcttccggacggtccgccgatcagccggtggacatcggactgtgttcaacatttgcccgggaggatgctgtttcgcattgaacggaaattttatgtttatttgagaggggttctccatccgatcagtcatgacgtagcgaaacgattttttgcgaatcagaaggcgatacccatttcctttcagcaaattaaacaattaccaattggaatgccgttctatccggtgtacgatgaaattataagaaatctcaatataacaaaaggttgagagatgcagtcggatgtgcaaggaaaaggagagcttttatgaccgatcaatttgataaaaccgagaagcagtatatagagcttacttccggcattcagaggttcgagcatttcagtgtatatacggacccttttttgccgcagattttttcgcataactttgttcagctgcaccgtacatttccgttagacaaactgctgccgtttctttcgtccgttccgggcatgcttcaagccaattatattcatgtgaaagcgtctccggagcacgcatttccgcttcttctgaaacaaactttggtaaagcagggctgcgtagtggaagatgagctgttttttgcaaggaaactggaaaatggggacctgcaggccggacacccgctcactgcttgggggacggaaaagagcctcgccgatgggtcgtctattatgaacatctatgatgccctttacattggcgaggcggcggccgaacaaaagcttgagcggaaatatcctttgtataaggagggaacggttatgcttgtcgtgtgctacagcgacgcctcgcaaacgattccgatcggctgcggagagcttttcatcaacaaagcagataaaaccgcaaaaatagaagaagtcgcaattctggatcaattccaacgaaaaggctacggatcgatattgatgaatgagctgatggcggcggcaaagctgaacggcatggaaaccgtataccttgtgacgtccgggatggacggtgtaaaccgcttttatgaaaaactcggcttcaaaagatttcggcgcgtgcatacaatttttcattattttcttacatagttgggcattcgcataaaccaattgggagttggcccgcatacaatgccgtatatcgtaagaagaaaggatgatttgcgtatgtacggatacggatatggctacggttgcggcagttttggctatggttacgggcacggcggctgcggaggcggaaccagcacttttgtgctgatcgtggtattgtttattttattaatcatcgtcggtgcggcttttatttgttagactgaaaaaatcctataatgaaaatcagcctgcagagaacatcattttctgcaggctttttgttatttccatgctgaaaaatcagcttgaaaaacattttaatacatattacctttctggagaagggggagaaaatgtgaacatgacgattgaagaattaccagaatccagaattgcttatttccgaaacgtcggagagtatggcggaaagcaaaacaaagaactgatggagtcatttaaaaactgggcgcaattgaatggtctgcttgattattctgtcattttaggaattccgcaagatcatccgaatcgtactcctaaagagaaatgccgctatgatgtttgtcttgttatcaatcaagaccatgtgcctgaaccagcccggatcggtacattttccggagggaagtacgccgttttcttgcttgatcatacaaaagaggcagtcagcggattttggaacactgttttttctgagatcgaaaaaaataatttatcaatcagagaacagcctattatcgaaaggtatactttacaaaaggtgaatcatcatttgtgtgaaatattgattcccatacagtaaagaagacgggaattttccgccttctgcttatactgattcagatcaaaaatgatgggatgagcagataaatagcagaaccgaagaaagaataaaatcaacaataggaatagaatttccagaacgctcttcaggctgtcgggacatttccggcagcctgttttacagaaaggtattttctgcaaaaaactttctgaaggataagaatgcggttattcatctgttcatacaatgaagcaaatgggttttcgaggtggaaagatatggggagctatttaatcaaaccggagcttgacgcaaattatccgtcagtcagtcatggtaagggatcatatgtgtatgatcaggaggggaacaagtatcttgacggagcatcgggggcggtcacttgcaatatcggccacggcacggaggatattatacaagctttaaaagaacagcttgactccgtttcgtttgtgtatcgctcgcaattcaccagtactccggcggaagaactggctttatttctggccgatcatctgccgggcgggctgaattggtcattttttgtaaacagcggctcagaggcagtcgaaacagcgatgaaaatggccgttcaatattggcaggaaaaagggcaataccaaaaatccgtctttctatcaagatggggaagttaccacggcattactttgggagcgctttcattatcagggttctatgaacggagataccgcttcacccagctgcttgaacggtttccggccgtttcagcgcctaatatgtatcgttcagagctgcagggagaggaatttgtgaaagctgcggcggctgaactggaaacggctgttcagcggatcggttcctcatttatcgcgggatttgtcgcagagccgattgtcggagcagccggggcggccatcactccgccggcaggttattatgaagcgcttgaggttgtctgccgcaggcacggtattttgtttattgcggatgaagtcatgacggggctcgggagaacagggcggatgcttgcttctgagcattgggggattgcccctgatatcgcggtgctcggaaaagggttgggcgccggttacgctccgattgcggcagctgttgcgtctgatgacatcattgaaacgatcaagcggggctccggggtcattatgagcggacatacgtacagtgccaacccatactgtgcaagggcggcgcttgaagtgcttcgctatgtcaagaaacacgagctgcttcggcagtcagaggaaaaaggcgtaatgctgaagcggaaattagaagaaatcaaagaccgcagcggggtgatcggggatgtccgcggtaaaggcctcctgatcggggttgaattcgttaaggataaaacgacgaaggacgttttttcgaaaaaacaggccttcaccgaaaaaatcattaaagcggcaaaaaatcggggcctgcttatttacccagcaaagcccggtattgacagcggagaaggagacgccgtcatcatcgccccgccgttcacgatttcatatgcggagctggatgagctgtcagatctattttcccagtccgcagaagaagctgaaaaaatgatgaagaaggattgagctgatatgtctatttttcataaaaaaatcgatattcatgaagcaattgccgatgtcaaggacgaatctgtcatcatgttcggcggttttgggggagtgggttcacctccgtcattaatcgaagcgattttggaaagcggcgttaaagaattgaccgtcatctgcaatgatgccggatttccggaaataggtatcggtccgcttatcgttcataagcgggtaaaaaggctgatcgcttcccatatcggctcaaatcctgtcgcgggcagacaaatgactgacggagcgcttgaggtggaattttcgccgcaagggacgcttgctgaacggattcgcgcaggcggagcggggctaggcggtattttaactgatatcggcattgataacgcaaccgtttgtgaaaacaaagaaaccgtaacgattgacggaaagtcctatttagttgaaaaagcgctgacggctgatttcgcttttgtgtcggcacatattgctgatgaattcggaaatctgacgtttgacaaaacggcgcgcaacatgaaccctctgatggctgctgcggccgaaagaacatttgctgaggcggcagaaattgtgcctgccggcgaacttgacagcgagcatattgtaacgccgggcgttttcgtggagggtatcgtgcaaagtgaaggagtgaagtggagatgggcttgggaatagcggaaagagagagtatcgcgaggcgggccgccagtgaaattacctcaggtatgattgtcaacctggggatcggcattccttctttagtgccgaactttctgccggccggcatggaggtaatgctgcaggcggaaaacggcgtcctcgggatcggcggtagtccggagcgcggagaggaggatgagcttttatgcaatgcggccggatttcctgtcagtacagttaagggtgcttcctattttgattcagctctgtcttttgccatgatcagaaaagggctgatagatattaccattttaggcgcgctccaagtcagcaggacaggtgatctcgccaattggctcgtgccggggaaaaaggtgcccggaatgggcggggcgatggagcttgcccaaggcgcgaaaaaagtggttgtcgtcatgagccacaccgatcagaaaggccggccgaagctggtcgaaagctgttcattgccgcttacagcagcaggctgtgcagatctcatcattacagagaaagccgtcatcagcatagatgatggggcttttgttcttgaggaactgctgaatggcacgaccatagacgatgtcattcaaacaacggatgccgaaatcagattgggagaatgttttcttaaaagggggtctgtccatggatcaattagaaaagaaagtcactgagtgggcggaagaaaacacagcaaaagcggtaagcctgctgaaacggctgatcggggaaaaaagcacgttcggccatgaatttaacgcacaggcagtcgttttagaaaaactgagacagtttgacatggatattgatgtctgggagccgagtgtcaaacaattgaaagagcatccttattttgtatcggaacgcgaagacttccatgaaagcccgaatatcacagccgtaaagaaaggggccgggggcggaagatcactgatactgaacggacatattgatgttgtcccggaaggaaatcccgccgcatggacgtatgaaccgtttacagctgttgaaaaggacggcaaagtttacggacgcggttcaacggatatgaaaggcggcaatacagccctcttgtttgcgttagaagcgcttgaagcctgcgggattacgttaaaaggagatgttctgtttcaaagtgtcgtagatgaagagtgcggcggcgcgggaacactggcggctgttatgaagggctacaaggctgacggggcgcttattcccgaaccgactaatttaaagctgtttgttaagcagcaagggtccatgtggttccgcattacggtaagaggattgtccgcacacggcggcacccgctatgaaggggtgagcgccattgaaaaaagcctgcatgtcatcacagcccttaaagagcttgaacacgtccgtaacgcccgtatcaaagacccgctttatcgggacgttccgattccggttcccattaatatcggcaccgtccaagggggaacgtggccatcatcggtagctgaccgtgtggtgatagaaggcaggtgcggaatagcgccggatgaaacgcccgaagcagtaaaagaagagctggcaagctggctgaaagatttggagtaccgggatgaatggtttaaacaccaccccgcggaaatagaatggtttggggctcagtggcttccgaatgatctcccggatgagcatccgctgatttccgctctggaatcttcttttgagaaaatgaaaggggcaaaaccggttcgtgaagcgtccccgtggggaacggacggagggcttttgcagcacgcgggacagacgccggtcatcgtcttcggtccgggagaagtcaaggcggcgcatcaggcgaatgaatacattgaagtccgggcgttaatcgatgccgtcaaaatcatttctctttttatcatggaatggtgcggggtggcagatgggggtgacagcgctgataaaggaactgagggctgaaagcggagcggccgagattgatgcagaccgtttcaacgagcggatcagggtcattcgttatgacggacagcccgaggcgcttataccggccgttttggcagaagcaaaggaagagggagcccaaaaggtgattttctttgccaagcgcggcgatgagccggaatttgtcaagcatctttttattattgagggtgccatagacgggtattacaacgggcataaggctgttgtgatggtgcgctatttatcagaggaacggagacggtcagattcatatgtatcagaagattcggctgttgaccgtttatatgagacaccgcggcggggaatgactcagacagaaagcacgctgatgttcagaaaagcggacgaagatgatgcggaccgtttaacgcacttatataaacatgtttttcttacctatccgactcctgtttttaatcccctttatattaaaaaaacaatgaaagaaaacaccatctattatgccgcattcgatcaggatcgtctcattggggcggcaagcgcagatatcaatccggttttggggcacgcagaaatgaccgattgcgcggttctgtcagattacagggggaactccgtaacggcacacttgtttaaagcgttggagcaggaactcgctggccggggaatcattcatcttttttccttggcccgtgcagcgtcttacgggatgaacgccgttttgtatcatgcgggatacggctacagaggcaggcttgtgaacaactgccgcatttcagaagggctcgaaaatatgaatatatggtgcaaaactttacgtttggccattcataaggaggaattcgtttgacaaacaaatggtttcagccgaagcgtcactggaaggagattgaattgtggaaagatgtgccggaagaaaagtggaatgattggctgtggcagctcacccatactgtaagaaccgtcgatgacctgaaaaaagtcattcatttgaccgaagaggaagaagaaggcgtcaggatgtctgtaaaaaccattcccctgaacattacgccttattatgcttctttaatggatcccgataacccgagatgtccgatccgcatgcagtccgtgccgctgtcagaagaaatgcacaaaacgaaatatgaccttgaagatccgctgtttgaagatgaagattcaccggttcccggtcttacgcaccgctatcctgaccgcgttctttttctggtgacaaatcaatgctcgatgtattgccgatactgcaccagaaggcgtttttccggacagatcggaatgggggtgccgaaaaaacagctcgatgcggcaatcgcttacatccgggaaacgccggaaatccgtgactgcctgatttccggcggagacgggcttttaattaacgatcagattctggaatatattttgaaaaacctgcgtgacattccccaccttgaaattatcaggatcggaacgagagcgcccgtcgtatttccgcagcggataacggataacctttgtcagattttgaaaaaatatcatccggtctggctgaacactcattttaatacgagcatcgaactgacggaagaatcggttgcggcgtgtgaaaagctcgttaacgcaggtgttccggtcggtaaccaggctgttattttagcaggcattaacgattcggtgccgattatgaaaaaactcatgcatgatttagtgaaaatccgcgtgcgtccgtactatatttatcaatgtgatttgtcagagggaatcggccatttcagagcgcctgtgtcaaaaggattggaaatcattgaaggactgagaggccacacaacaggctttgccgtgccgacctttgtcgtcgacgccccgggcggaggcggtaaaatcgccctgcagccgaactacttgctctcccaaagtccggagaaagttgtgatcagaaacttcgaaggggtgattacatcttatcccgagccggaaaactatatcccgaatcaagctgacgactattttgaatctgtttttccgggaacaatggccaaacgcgagcctgtcggactgagcgccattttcgcggacaaagaggtttcgttcacaccggaaaatgtatcgaggatcgacaggaggaaaacgtttacatcaaaccctgatcatgaaacgctgaaagaccgcagggaaaagagagatgaattgaaagaaaagaaatttattgcacagcaaaagaaagagcaaaaagcaggatcggaagtcggaggtgagtcgccgtgaagccatgcgagtggtgcggcaatcagaaggcgtcagcttgtcaggcggctgtgtactgggagcttcctgacggtacgagagccatagaaattacagaaacacccgcattcgcctgctcctcctgcggcatgacgtatcaggaggaagcggtcatagcggaaatcgaaaatcagctttttttagtcgatgcaaaaaaattaccggaaacactcacatatcaagagctgatggggacagaacggatcttgaaacggaattattttgacttctcctagtcttcttttgttgtaatttcacacttgaattgtataatagtacaacaaaagacagtcatcaggaggggaaacccatgaaatccttttatcactatttgatgaaatacaggcatcccaaaccgcaggacgcaatcagccggtttgcgaatcaggcatacgaagatcacggctttccgaaaacgtcaagcgattatcacgagctcagttcttatttagaactgagcgccgactatttagaaacgatggcgacatttgatgaagcttgggaaaaatatgagaccgaggtgcatcacgcctgacgaaaaaccgcacattgtgcggtttttttctgttgaaatcaatcgcttatgaggtgccgtatgatcaaatcccgcaatgcctttcgttttgatcagcgcgtaaacaagtcttcctgatggcacggatcataaggcagcagaatgtatagctgcagagttcaccggatcagacctgctgccggcggggtcccgtgtaaggagcctcttttcacggagaaataatcaaacatttaaatgaagtgagaggaatcaaatgatctatggtgaggcactgacgtttggacggaaaagggaattttatgtgacaaggttgaagcggattgaagttgtggcttcattgaaagccgaaacgagtttggttcttcatgataaacaagccattgcagatatgcagccggaattggatctccatacatcttcgatgatgtgtttcacggcaaattttgaacatcacggcggtgatattgtcaacatgccttcgggccgggtatttatctttgtgtcatggagaaataaacaaaaactcattcaaaaacaggcgctttttgtctcgtcattgttactgctcattcgatcgagagcgcaatgccatcagacgcttctgttacggtaagtgaaaaaacgcacaagcatgttggggtttttgccattttgaacaggtgcagaaatagatatttcctgtggttttcatgcccatgcgaaattatggcggccggcatacgatagcgtatgacagtccgcggcaagggggagacagcatgaagccagataaaccgaaatttcaagtgggagacatcgtggtcgtcgtgatgtacggaaccgtcggcaccattacgaaggttcatcaaattgataaacattatctttatgaagtcaatcataatgaagtgctttattttgaatcgtccatccagctttataaagattatgagggcgtgatcgtcgatatggaaaaattagatattgaatatgaatttctgatcggcgacgtcgtatatgtaaaggactacggaaaggaattattccgagttatcggtcacagaactgaaatatggagatatttagaggatggctgggaggatattatttatgagctgactcggctgaaagacggagagtggcttgaaacggaggaagaggatctcacgctggttctgagaaaatatgaaatggatcagtttgtgcatcagctgctgtttgtccactatgttggggaagcatctcatgagatcggcgaggataccgtcgcgtctgctcttcttcagtttgaaggcgatgctgatgatcccgatgccctgcatgtgctggcggtatcgattgtagatgagctgcttgatatttataacgattataagattctttatcatttgttcggtgacgaagaatataaagatatgatgaattttgtgctggaaagcctgcgggagcatttcagctagccggcaaaaaaacggacggtgacatataaaaaccagggcagacagccggcaaagatgacaaacgacattcctttcagcactttttccaatacgatatcaaatccatctccgtccaataaagccatcattttcgtcattatcttttctccctccggggcttgtttttttaaaagtatatgagcggacaaaacgtttagaactttcgggtataatttgaacggttttttcataaaacataaaaaaggaggcggtgtttgcatgaaagaaatagatcttgtgattgacacagaagaaatagctgattatttttacagtcagcttgctatgcgcgggtacataccgagtgaagaggaaatcttcgaaatagccgacatcacctttgattatttattagaaaaatgtatgatagacgaagagcttgatgaagactgaaactgcggaaccgaagtgaaaaagcttcggttttttcaatcagctcgggagaatgaaacatggggggaaaacgttgtacaagccagcaagtcttttcgcattgtttattctgctcgcagcagcgatccggatagaagccgtccgggcttttgatgagcgtgtgatagaagcggctgtcaggatcaggtctgtctggctgaatgaattgatgttatggataacggagctcggcacgaccgcggtgcttttgccgcttcttcttttgacaggcgcagctctgtatatgtacaaaaaaacgccggatgttgtttttttgccgcttctctttctcattgaacggattgtaaacataaaaataaaagaattgattgaaagagccagacccgcttttgaaccgctcgtccatgaaacctcatacagttttccgagcggccactccatgaattcggcagtgatgtatcccgtcatcgcttactttttgatcaagcatgttccgtttttcacgaaaagaaagagggccctcaccgtctttaccggagttctcgtcattctgatcggattcagcagaatttatttgggcgcgcattttccgacggatgtccttgccggattcagtctcggactttgcctcgtttcgctttttgcgctctttgacgaaaagtatcatccgtttcgacaaaaatagagacaggaaaaatgagaaaaaacgctaatactattaagaaataagagggagggatcttgatgctgttatcgctgcccgtgtttaaaaaaaagacttgtgcctatgatgtgacgatttttcaaacaccccgctacggcgagaaaaagggatacagggtcgtctatcggacagagctggccgctgacaatcatcaagacgcactggaaagggcattttctgtttttaatgtgcctgatacggtcccaaacgactatcaagccagattcatagcgaccggagacgtcatactcatagacgaaggaagaaaaggaaagacctattacaggcttaaccctgcgggatggagtaaaattaaccggctgctcgtccagccgaggtaagacggagccggctgaagattcagccggcttccgtattgtctgggaaagacagtgttaaggcttccgtttagcggcggaatgctcttttccatgcgcttcatcagctgcaatgacgtctgaaacgggcacgtgattgttctttttctggccggtcacccggttgcgctgttttttgcccattatgttcactcctttttctttaggcttgtcatcccgcatattctgcccaagattgccctgatcaatgctgatgattgtctcttaccgttattcagtgtacaatgggtgggagtttgaataggcaggaggaaaaggaaatgagtgtacatataaacgcagaaaaaggccaaattgcggatacagtgcttttgccgggagatccgctccgagcgaaatttattgcggaaacgtatcttgaaaatgtggaatgctataatgaagtcagaggaatgtacggatttacgggtacatataacggcaaaaaagtatcagttcaaggcaccggcatgggtgttccgtctatctctatttatgtgaatgaactgattcaaagctatgatgttcaaaacttaatcagagtcggctcatgcggagccatccgtaatgacgtgaaagtgcgtgacgtgattttggctatgacgtcttcaacggattcacagatgaaccgtgtcgccttcggcagtgtagattatgctccttgcgcagacttcgaactgcttcataaagcgtaccaggaagcgcaaaaaaacaatcttcccgtagcggtcggaagcgtattcaccgccgatcagttttacaatgaagactcccaaatcgaaaagcttgccagatacggcgtcctcggcgtagagatggaaacgactgctttatatacgcttgccgctaaatacggcaaaaaagcgctgtctatcctgactgtaagcgatcacgtattaacgggagaagaaacaacggcagaagagcgtcaaacgacttttcatgatatgattaaactggcgctgcatactgtatcgtaaacttgagatgagggttatgctgattaaagcagccctcttctttatgcatcgccctgattcaaaaaaagaaaggtaagggtaaaatgaagaaatccactaaatggttctcgctcgctgccgctctcagcgtaaccgcaatcgtgggcaccggctgcagcatttcagacggcgacagccataaggacacaaaaacagcagctgaaacaaaacaatcagatgacacatcaagcaaaaaaacaacgaagacagaaaacagtgattttgtattagagagcaaatattttaatgatattaaagaagtgaacgggcttgagaccattcaaaacccgacaaatacacttgcgctcgtaaataagacatatacgctgccgggagattataaaccgaatgatctcgtaatcccgaaagtcgaattttcttttactgagaaaatcgagaaacgatatatccgcaaacctgccgccgatgctttggcggaactattcagcgccgggaaaaaagaaggttatgacctggttgccgtttcaggataccgttcttatgacagacagaaagttattttcgataatgaagtcagtctgaaaggtgaaaaaaaggcgaaagaagccgtcgcatatccggggcaaagcgaacaccagacggggcttgccatggacatttccagcaaaagcaacggatatgagctgaatgaggcgttcggaaacacggcggacggcaaatgggtgaaagaccatgcgtatgaatacggctttatcatccgctatcctaaaggcaaagaaaatgttacaaagtatgagtatgaaccatggcatttacgctatgtaggcaaaaaagcggcaaaagccatccatgaccatcaattaacgcttgaagaatattttaatgaagtaaagaaagtgtaatgagaagaagcccgcttgaaaaatagaaagcgggctttctttattaccagaagagcagacctccaagcgcaaatccggtaatgaaaccaaggccgataccgtaggctgctccccagcctccccagcctcctccccaataaccgaatccgtaccctctgtgacggccgccgacaggggtgatatacactttgctgttagtcacccgtacgattcttccgacgtggactctgccgtttcgttctgtaattcttgctacttttccttggtgctgccggcaaagatgataatagttttgcatcttttctcctcctatccaacctatctttctatgtcagcttatgatagagtgcggtaaaaaggttggacgaaaacaggaggacaattgccgttttacttgtaagcgacaaaagcgcagtgtcccatatattcacggtacgtctgcataagctcgtaatgagccgtcagcgtatcgtagtgaaccggctgaataacgggcgataaatccatttctgtagtcggctcctgcgcattgttttcatagacagcgggaatgaaatccgctttctgaaagccttgctgaagcaatctctgtttccatgcggtttcatcctgcaatacggtaaaaccgtagaagtcttttatctgcgtgatggcgttttccggcatgggcttttgtaaagcagcttcaatgccgatcagcatgcccccgggtttaaggacccgcaggatttcagacagcgatgaatcaagatttgaaaaggtgagaactgattcggaaagaacggcggaaaattgattttcagcaaacggcagccgctcaagctccgctaaatagcccggaatggttaagccttcagcggcaaatcgttttgctgctttttcaagcataaggggatccttatccacacaggtgacgggatacagcaggtggccgagataagcggccgtctgtcccgttccgcagccggcgtcaagaatcggttcgccaggaggaggagccgcttttgtgagaacggctttggaaaaagcgagcccgccggggtgagcccctccgactccgaataaggacagcatttctaaatatttgctcaaaggccgaatcctccttttttcctcagcatatgttgagagaaaagcataggtttgggtaaacgggaaagaagggcgcctcacgtttgaagttgacgaatgagcgttcgtctatgataataatgtaagaataaaaaggtggtgttttcttgaagcggcaatttaaactgttttttattatattgatcactgcggtcgcagcctcagcgcttacgctgtttatcacgggcaatacgaccattttcggacaaggctcggctgctttgacgaacagcaaatttgagaaattcaataaagcctatgagcagattaaaagtgattactatcaaaaaacagatgacagcaaattagtagacggagcgataaaaggcatgatcagttccctggatgatccgtattcttcttatatggatcctcaggaaggaaagtcgtttgaagaaacaatttccgcttcgtttgaaggcatcggcgcacaagtggaagaaaaggacggcagcatcctgatcgtatcgccgattaaagggtcacccgcggaaaaagcgggggttaaaccgaatgaccagatcttgaaggtcaacggcaaaagcgttaaaggccttaatgtaaacgaagccgtcgcattaatccgcggcaaaaagggaacaaacgtcaagcttgtgctgcacagagcgggtgtcggcgatctgaacctgtcgatcaaacgtgacaccatcccggttgaaacggtgtactctgaaatgaaaaaaggagacatcggcgaaatccaaatcacatccttctccgaatcgacggcaaaagagctgaattcagccattgacagcctcgaaaaacaaggagcgaaaggatacattctcgatttaaggggcaacccgggcggcctgatggatgaagccatcaaaatgagcaacatgtttatcgataaagggaaaaatatcatgcaggtcgaatacaaagacggcacgaaagaagtcatgaaagcgacgaaagagcgcaaagtgacaaaaccgacagtcgtcctcgtcaatgacggcaccgcgagcgccgcggaaatcatgtcggctgcgctgcatgaatcatccggaattccgctgatcggcgagaaaacgttcggaaaaggaaccgtgcagacggcaaaagattacagcgacggttctaccgttaaactgacaatcgcaaaatggctgacagcggacggagagtggattcataaaaaaggcatcaaaccgcaatatcaggttaagcttcctgaatatgcgaacctgccgtatttagatgcgaaaaaaacatacaaatacggggattccggaacgaccgtcaccaatgcgcaaaaaatgctgaaagcgctggggtacagcgtgaatgtaaacggcacgtatgataaagcatttgaacaagcagtcaaacaattccaagcaaaagagaagctgaaacaaacaggtattttaacgggagacacaacggcaaaactgatgacggatctgcaaaaacagcttgcggacaacgatacacaaatgaaaaaagccgttgaaacattaaataagaatatgaaatagtaaaaaacacccgatgcgtcgctcgcgcatggggtgttttttgtttgcgaaaagcccgtcttatgtcgtttcctgttcaaaaaggtggctgttcgcctgaatgaaaaactgtgattgctcatagtgataggtgacttttgagaaatcaaacggctggccgttggttaaatgaaaaatcgtttcaacgcaaagcttaggcgctcctgtaaacagacctaagtactccgcttcttcctcatttaacatccccgcgtacagatataaatctgaaaaaccgcgctttaacccgagaccgtctctaatataatcaaatatggattctgccacgatctctttattcaaatacgtaataatggatttgttgtaaaatgactcttcgatacacaatgtcagcccgtcaatatatcggattcgcttgacataatacacgtcgccgtcaggcggcatattcagattttgagcagcctcaggcgtgggttttctcacttccagcgctaataatttggaagtgacattaaaatcttcaagtgattctttaaatccctgattagaaagcagactgatatacccttttcttttattccgtctgacaaaaatgccgcttcccctcacttgaaacacaatcccctttttttctaataaatctaaggacttggttatcgtgcttttgctcacgttaaaccgggtcattaaggtttgcagcacaggcagtttatccccttgctgcagctgatgttcttctatgtatttttcaatatctatcgcgatttgctggtattttaacatatccattcctcattcatttattgtcccgcttctttcagaattatagcataatcgtttttaaaagccatttcgtaaattaactataattgtttatgtattgataaattataccggtacaattataatgtaaacgtataatatgaaaatgaaggcaggaattcttctacacctgcgaagcggtgcttgaagctgctgcagtgcatttattcggtatgcaagcggcagtcaaataaaggaggatataaacgatggggacattgccaaaagattttttatggggaggcgctctggccgcccaccaatttgaagggggatggaataaaggcggcaaggggccgagtgtagtggacgtcatgacggcaggcgcgcatggtgtgccccggaaaataacagatacaattgaagagcgggaattttatccgaatcatgaagcgatcgatttttatcatcgttataaagaggacatcgcattattcagcgagctgggcctgaaatgtttaagaacgtccatcggctggagcagaatttttcctaaaggtgatgaagcggagcccaatgaggaagggttggctttttacgaccgggtgtttgatgaattgctgaaacatgggattgaaccggtaattaccttgtcacattttgagatgccgctgcatttggcgagggaatacggcggtttcagaaacagaaaaacagtcggattttttgtgaaattcgctgaagtgtgttttgaacgctataaacataaggtgaaatattggatgacgtttaatgaaatcaataataagatggatgtgaataatccgatctttttatggacgaactcgggcgtcgccgttaaagaaaacgaaaacgcaaaagaagtcatgtatcaggccggccatcacgaactgctggcaagcgcattggctgtttcgaagggaagagaaatcaatcctgagttcaggatcggcgcgatggtatcacatgtcccgatttacccgtactcatctcaccccgatgatgtgatgctggctgaagaaacgatgagacagcgctttttcttcccggacgtccaggttcgcggatattatccaagctatgcgttaaaagaatttgaaagagaaggctatcagatacactttgaagacggtgatgaagagattttgaaaaatggccgagtggactacctcggattcagctattacatgtccactaccgtaaaaagtgacgtgataaacgataataccggggatgtggtaaacggaggattgccaaacggcgtggaaaatccttatattacagcgagtgattggggctgggcgattgacccgaccggtttacggtacacattaaaccgcttatacgaccgctaccagattccattatttatcgtggaaaacggattcggcgccattgacacattagaagaggacggttcaattcatgacgcttcaagaattgaatatttatcgtcacatataaaagctttggaaaaagcagtcacatatgatggcgtggatgtaatgggctatacaccatggggaattattgatattgtgtcatttacaaccggagaaatgaaaaaacgctacggcatgatttatgttgatcgggataatgaaggcaacggttcaatgaagcggcttaagaaagactcatttgaatggtataaaaaagtgattgaaacaaacggcgcatatgtatcctaaaggtgtaaaaagggaaggcttcaccgttgtgtgaagccggctttttatcagtaattatgaaagcgcattcattaaaacgggaaggaggtgactgtccggcttttcatttagaatcgcttataaaaataaggaaagggatggtggttcatgttttttaaaaaaagtctgcacatgaccctggtttttcttatgtttttctttttcatatcaagcagcacggaagccgaagtgtatgcggctgatcggaaggcttcagacaaaaacaaagtaagggtgtggttcagttctgaaaaagatccggcttcccgtacgtggtatgacgggccgctggaagtgaaatacgccttagacgaacaaacaccgcttacatggacaaaaaagaaggcttctgactccgccgccgtgtatattgatccgtcgcgccgctatcaaagtgtgttgggcgtaggatcgtccctggaagaatccacaatccataatttatcaaaaatgacacccgcaaaaagaaaagaagtgctgaaaaaactggttgatcccaaagatggtatcggcatggacgttatgcgcataacgatcgggacatctgattttacggcacaggaattttatacgtatgacgatatgcctgaaggccaaacagatcctaagctccgtcatttctcgatccaaaaggatattgatttacacattacagcaaccatcaaggaagcgctggcgataaatccggaactgaaaatcattgcctcaccgtggagcccgccggcttggatgaaaacgaatgaaaacctcaagcggggaaagctgaaagataaatatatcggcgcactggccgtttacttccgcaaatttattgaggcgtacgaaaagcagggaattccgatttatgcgatgacccttcaaaatgaacctttgctggaaatcgactatccgagcatgtacatgccgccgtctcaggagcgcaaactggcgatagccgtgaaaaaagaattgaaaaaacacataattgacacgaaaatttggatttatgatcacaatgcgagcggggcgtggaactatattccgccgattttagatgataaaaaaggaaaccgggcggcagacggcatcgcttttcacgattatgacggtgacctttccgtcatgtcggaaatcggaaagagatatcctgatcaatctattcacttaacggagcggtctgtctgggggacggcaggggcggatcggatcgcacagtatttccgcaacggcgcgtcgagctacaatgcgtgggtgacgatgctcgacagtcaaattaagacgcatcattggataggcaccccggacccgacgctgtttattcaggatgctaaaaaccctgaccgctattggaatatcccgatctttcatatgacaggcaacttttcaaaatttatcgagcgcggagccaaacggatagaaagtaattacggctccaaaaacacagtctcgaatgtatcgttccttaatcctgatcaatccattgtgacagtcgtaatcaaccagacatcttcagaacaaaaattccatgtcgtttcagaaaatcggcagtttgaagccgtcatcccggctaaaaccgtcgccacctacaaatggcagcacaaaaagtaaaaaagccggcacatcgatgtgccggcttttttctgttaagcgcctttttggttcagtttatcagagggcgctttattgaataaaccgtctttgacggcgtttgaagacgctttttttacaaaaaacgggttaaggataataacggcagccatgttagcggtcaacccccaaaacccttcatatataccgtgggcggattgggtgatatttaccgtgaatgtcacgataagaccgacgagaagaccgataattgtcgcttctttcgtttgattcttccaaaacagactgacggcgatagccggaaagatctgaaccatgccggaaacaccgagaagctgaagggtaacgagcgcagtcgggaacagcataccgaataaaagcgcgagcccgatgacgacaaataccattgaacgggtgatcatcgtcagcttgcttggtgacacattcgggtgaatcaaatcccgatataagttattcgcaaataagtttgatgctccgatggccatgatagagcagggaatcaatgacgcaagggcgatcgtggagtaagcaaatccctgtgcgactccgccgtaagacgtttgaatcagcttcaataaagcgagccgcggattggtatcttccggaaggacaagaaacgcgataaagccgagaaaaataacaagaatcaaaacaatattataaagcggcagaaacatgctgtttttgcggacggcatctgcgctttttgccgtaaatacaccggttgccgcatgcgcccacataaagagcgccagcgcagatacgatggaagctgtgataaaccaaggaattcctttcggccccgagtccggtatcgtcagcatttgcggcgctttttcagccaaagtgtgaatcatcggcgtccagccgtgaaaatggatcagcgggagtgagacgaccataaacagcataatcacccacaccagaatgtctttaataatcgccgtaaacgtcggccctttaattccgctgaaaaaagtatacagcgctacaagaataaaagagatgatgacgaccatattgacattaatgacacccgttccggccacctgaagcgtatcttgaatcccgctcagctggagacaaatataaggaatgagcataagaacgccgacaatggcgacaagactggccaaaagtttactgtcaaaacgctcacgggcataatcggcaagcgtcgttaatttgtgaatttttgccactttccacaatttcggcagaaagaaataagcgataaaatacgccaaaacagaatacgggattgcaaaaaaagcaacgcttccccctgtgtaggctgtgcttgttaagcctaaaaacgtataagccgtatagagatccgcgccgactaaaaaccagacgaggagccccccgaaccgtctgccgccgacagaccattcctcaacagaagtacgtgatgatttgtctcttccggctataaagccgatacagacaacggttaaaacgatgacggctgtaatgatcaatgctgttatatttgcgggcatcagtccagtcctccttgtttcttctgcagcctataaataagaaacgaacataatggagtgactgcgatccataaaagcagccagaaatgaaaaaagggcagcccgataatgatcggatgaacccgattagcgactgacagcagggccagctggctgaaagggattaagatgagaacgaaaattagtgcttttctgaccatttactttcctcctgaaacttgataatgctccttatcatagcaggtgtcagataagatcacaagatatttttcagaaaaaaaagaattctattacttttttaactgaaacactttagttgcatcttcattcatattaaattagaatagttaatatctcgaaatcaagatatttaggagtgaatacattgaatacacaaggattgcaccatgttaccgcatttgcaaaagatcctgctgaaaatcttcggttttatactgaagtgctgggtttgcggctcgttaaaaaaaccgttaattttgacgacccggccacttatcacttttatttcggcaaccaaaacggagagccgggcacgatcattacattttttccttttcagggaagccgcccgggaaccgtgggaaaagggcaggccggaagaatttatttctccgtgccgaaaggagcactcgcgttttggaagcgccggcttgaagaaaacggcttgtctgtaaaagaacagatcatgctgtctgaacaagtccttctctttaatgatacagaagacctgccgcttgccataatggaagatgaaagaagcggacagagtgaatggactccttcgggcattactgaaaaagaagcgatcacaggcatgagaggtgttcttctgtactcgtaccgtcctgaagcaaccattcaatttctcatagaacgcttcggttattcaaagacaggagaagaaaatcaaattgtcaggctgcaatcggaggcaaggatcggacatattatagatgttgaccttgcgccgaaagaagcaggtgccggcggttacgggacagttcatcatgtcgctttccgcacgagcgaaaaagagcaggcggagtggaaggatattcttgctgattctcatcttgcttcatctgacattcttgacaggtcatactttacttcaatctatttcagagaaagcggcggcattttatttgaaatggcaactgacgaaccgggctttatgacggatgaatcctttgaaaatctcggaacagagctgaagcttccggaatggctggaagagcatcgcagtcagattacagctgttctgcccataatggagaaaggagaatgatgatgaaacatgtgtttgaacagggaacgtcagaaaatgttctgctgcttttgcacggaacgggaggaaatgaacatgatcttctgtcgctcggacgttttatcgatccgaacgcaagtctgctgggggtcagaggatcagtgtcggaaaacggcatgccccgtttttttaagcggctgaaagaaggggtatttgacgagaaagatttaattgaacggacggaagaattaaagaattttattgatgaagcggcgcaaatgtacgggttcagcagagaaaacgtgattgctgccggctattcaaacggcgccaatattgcagcaagtcttttgtttcattataaagatgtactgaaaggagcggttctgcatcatccgatggtgccgatacgcggagtgaagctgcctgatatggaagggctgcctgtgtttatcggtgcgggaaaacgcgatcccctatgtacaaaagaagaatcggaggagctttatcagtatctgacagatgctcatgcatccgttgctcttgaatggcaggagggcggtcatcagctcacacagcaggaagccgagcaggcacgagcctggtacagtgagcgattcctataaaaaacccttagtctgcttaagcggactaagggtttctttcatcttacagccaagttgacactttagatacaggcagccggttgcttttatgcgccggcttaacggctttaccgattgaaatcagcatgacgggcacgaaacgctcgctcacgtcgaattctttaacgaattgctctttattgaatccgccgatcgcgcaagtgtcgtagccttttgctttagcggcaagcatcagctgcatcgctgctaaagaagcgtttaaaaatgctgaatcgcgggcaaactgatcattttggtatgcaccgttaatctggcctaaaagcgtttgtttaatctcttctgtgatattgccttgctcagccagttcagcataaacgtcttcaccattttcatttgcttttaagtcgcctaatacggcaataactgctgatgaatcaataatctgtttttgattaaaagcaaccggaagcagggcagcttttgcttcatcactgtgaaaaacttgaaaatgccaatgctgaaggttccaggcggaaggcgcttgcgttgtgatttcaaggagttctgtcaattcctcttttgtaatgaccgcgtctttatcgtattctttaacagatgcgcgttcctttaaaacgtctaatacggatgtcatcatgtttcctccttcggataaacgtgttatcataatagaaaagttagaagcttactaaatgtaacttgaaaactaattttaatggatcacaaaaaacttgtcaattcatagatgaagggatgaattcacgtgggatatacaatgtgtcctaaaatggaatccgctttttctcttttgggaaaacgctggaacggcctcattatccatgtactgatggacgggccgaaacgatttaaagatatgaccgaaacgataccgacaatcagtcaaaaaatgctcgcggagcggctcaaagagctggaacaaaatgaaatcgtcgagcgtcaggtgctgccagaaacacctgtcaaagtcatttataaactgactgataaaggcatggcactgcaagccgtttttcaggaaatgcaaaaatgggcagacagtttttgcgagcccgggggatctgccaacgacacatgtgatgaataataaaggctgcccaaggcagccttttcttaatgataatgtttaatcgtcataaaaaccattaatatcaaaattgttcagattgaggttcaagccttttaattgatttaataaagcatcgaatgtaaggaaatgatcatttttacattccgccggaacatcatctggagaaaatagttccattcctccctcaatccactgtttccggtataactgaaatgccgcttcaattaaatgatcaggcgttacaataaaccctaagcttacgtcatggtcctcactgtagccgaattcaaacccgcagcaagggcagatatcaaatgttttttgatattcgccgttataaacgggacttgtctctaatcctttaaatccgcatatcaaacaaggatacaactcactaaccaacatccatccctcttttattcagtttgaaaacatccaaaacaagcagggaggccttttacagtttcccggttaaaaactgagcctcaccgagcccgaagctccaatcggcgttcccgttttctgtaacggaaatcatgacgtcctcgggtgatatgccgcattctgttttaagctgatcagccatcagttgatataacgtttctttctgatgttcggtgcgcgctttgctgacaatgctgatgatgacaagagctttgcttcttttgaaaccgagcccggtatcttcaatgataagctcatgaggccgatgctggtgaacgatctgataacggtccgttactgggacgtcaaaagctttaaccatggcgtaatgggcggtatccagtaacttttttaatgctgcgtcatcccggccttcaataacgtcaaaacgaagtaatggcatattttattccccctgatggttttataatatcgtaacttgtaaaaaaagtataacagttaatcaaaatataatcaaattataaccaaaatgtttacatattaatgcaatattaaagagaggcacatgttgttacaatcgcccaatcaatttcctcattttatgaatacgcttaagaataggcagacataaaggaggaaaaacatgtaccctcgtcatgcattgtatcgcgggaatttcggtcctgccggatttccggcgagaagtccttttttgttcggcgctcctttattcggcggatttttaggcggtcttctcggaggcgtgattgccacaggttttacaagaccccgctatccgtacgggtttgccggttacggatacggaggcgtcccatacggcggtttcgggccgggagccggcggttatccgccattttattaagaaaaaacggcctgcatcgcgcgggccgtttttttatcttaaaatctccacttccgatagattgtagtcttcctgttttgaaaacataacttcaatcatcccgtctttatagactgcttttgttcctttccgtttgacgaggctcggaagtacgatttctttttttccttctcccaggctgctgttctctacaacgaggctgtgtgacgtatgcttaatcctgatacggtcgagttcctcttgttcggcgggaattttcgcaaaaacatgatcggatgtttcaaacaggtcaatttccggcttgggcggttccgcttcgaccggatcggcctttttggacatcgggtcgcgaaaagggaactgtccggcataaccggcgccgaatacgctttccatcactcggttgacatatgtctcgacatctttcggatcagcatttttaaacgtttctttagagaactgattttggaagggaaaatatctgttccaatcaaacacggcatctcaccctttcttaacggacaacatagtatatgcccgccggaagcttcccgtgatataatataatctgtttacagaaaggaaggggaaggccgtgcaagggaataacgtaagaaaaggaatcatttataccgcttgttctttcgtcatgtgggggctgtttccggtctattggaaacttcttgaacaaatacccgcattggacattttagctcaccggattttatggtcatttgttttcatgtgtgtgcttttaactgtgcttaagaagtggaaaaccggatggcgtgaactgcgtcttttgaaatcggaagggggcctgctggcgctttttttcgcttccgttttaatttccgttaattggtttgtgtacatatgggccgtcaatcacggctttttgcttgaagcaagtctcgggtactacattaatccgctcgtttccgttcttttgggcatcctattcttaaaagaaaagcttaacaagatgcaaacagcagccgtttctattgccggggcggccgtgctcatatctgcgtttcaatatggcgcggttccttatatcgcattgctgcttgcattcagcttcggtctgtacggcttatgtaaaaaaagaacccgcatgtccagcacgatcggactgacgctggagacgcttttgattaccccggctgcacttatttatttaggatatacagctgacgggagcacttttgggtccttgggggcaggaacatgggcgctcctatttttcgcaggcgtatttacggccctgccgctgttattgtttgcagagggggcaaagcgtctgccgctgtatcaagtcggcattttgcaatatatagcgccgaccatcacccttatgcttggcgtatttgtgtatcatgaaccgttttccgggcaaaaagcgtttaccttcatttgtatatgggcagcattgcttttgtttaccttttcacagataaaatggaagcggccgataaaaagccgctaagcctttcgctttccagcgatagcttaaattatgtataatcattacgagtatgtaaaggagctgtacaatgggcactgataaagacatagcaaaagcctatcaggcactgtggaataaccgcactctcccggcttcaacccttgaagaagcggaaaaggcgattgatcttgaactgcttgatcaaagaacacatccgaggctccggaagtcacccgaggaaaagtttgctctggcggtgcagcgaattgtagattcccggctgcggccgattgagaaatatgaattggttgaactacatacgaagcgtttgcaatttttaaaagaagaaagaggggagcagctatgaaagcgatcataaaagaagatgtgcaaacttctttagagcgatatgccgatcgtcctgtatatatccatttggaaacaacgaccggttcttattcagcgcatctgaatgagaaaaatatgacggttgtagcctatatacgcaatgcaaaagtgacgtaccatcaggcgaaaatcaaaggaaacggcccgtaccgcgtcggtttgaaaacagaagagggctggatttacgcagaaggtttgactgagtatacagtagatgaagaagaccgtttgttaatggcggggcatctgccgggcggaaaattggcgatttcgcttcaaatcagcgaaaagccgtttacagtttaaagaaaagggtgaaaatcatgaaagaacatgtactcgtcatcctgcctcaccctgatgatgaatcatacggagtggcaggactgattgctttacacagacaaaaagatattcccgttacgtatgcatgcgcaacgcttggcgaaatgggccggaacatgggagatccctttttcgcgaaccgtgaaacactgccgctgttaagaaagcaagagctgattgacgcatgcaaagcaatggacattactgacctgagaatgctcgggcttcgtgataaaacacttgaatttgaagatgacgagtggctcgcggatatgatggaagagattatcgacgatgtaaaaccgagtctgattgtcacattctatccggagcacggcgtccatccggatcatgatgcatgcggcgaagcggtcatcagagcgctttacagaaagaaaaaagaggaccgcccgcgcacgctttgcatggcaatcacccgcaacagggaggaagccgtcggcaagcctgatgtcattcttgatattaaagaggttgccgatattaaaatgaatgccttaaaagcgcaccgcacccaaacggaaggcatgctgagagagctggaagaaaaattaaaaaataacgagccggttcttcagacatggtttgaagaagaagtgtattggacatatccgtggaaagactgataaaaaaagggataaggctgaaatgccttatccctttttttgtgtcagatcggaagcgatcgcttccgcaagcgaagaccgtattgataaatttgaaaaactcagtccgagctgcaccgcggtttgggcgatttcaggacggattccggataacgtcgctttcacgccgagcattccgagtgattcaattaaggtgaaaagctgttgggcaaccatcgtatcaatcatggctacgcctgataaatcaatgtacagctgcgtgatgcgcttctctgaacactggtgcagcgtattctccaaaatcattttggctcttgccgtgtcaatatccccgatcagcggcagcagtccgacattgtcaaaaagcacaattaccggcgagctcagctctgtaatcaattctttttgcgcttcaagctgaatgtttgtgtttttatacatttcctctatgaaaatatgaatgaccacatcaaacgatttaatcagcgtatggaatatatcttcggcatcttcttctgtcacggtgtctgaatgaagtctggtaaactgctttacatggccgacatacaaatcacgaactctgataaactcgcgaatgatgtaatggatgggagtttttaaatgttctttatcccgtgcggcttcaaacgcccacttttccaatgccgctgtatatacttccttctcttcagaaaaaatccgattgagttgataattaaacgccagattttgttttttcagatttgtgagaacagccgggtcagtagaagcataaacagaatcaggatccgtatcatgaagggtatcaaaccatgtctgactgatatcctccgcccgttcggttaaataatcgtacagcagtttatgtttcggcattgctgctcctcctttataaaatcatcatttttttcacataacgcttttgcagcttcatcagtctgaagaataaaccgacagctcctgcggcaagtcctgcaattaacccgatccagtagccgtatgccccgaggctcgtgtaagtgccgactgcgtaaccgagcggaagcccgataatccaatacgaaacaaaagccgcaccgagtgtatagttgacatccttatatcctctcagggcgccttgtatcggagctgctacggcatcagaaagctggaaaaacagcgcatagattaaaaagtgctgcgtcaacatgagcacctccggatctgatgtatacattccggcgatttgcggcctgaacagtaaaatgaaagccgccgtgcataaagaaaaacaaagggccatcacaatgccgatatagctgtatgaccgggcatccctgtaacgctttgcgcctgcttcaaagccgactaaaatcgtcatggccatggatacgctgagcggcagcatatacaagagggaagcaaaattcattgccgcctggtgggatgcaatcgtcaccgtccggaaatggctcattagaagtgtgacagccgcaaaaatgctcgtttcaaaaaataccgcaaaaccgataggcaaaccgattttcaaaagttttctgcattcagacggagaaaaacggtacagtttccgaaatacagagtacccggcaaacggctcaaatctgaagacgataaaaaagctgacggcgcaaatacaccagtaagtcagggcggaagcgagccccgcaccgactccgcccaatgccggcatgttgaatttcccgaaaataaatacataatttaaaacaaaattaataggcaatgagcaaagcgtaataagcatcgtgactcgcgttttgccgagtgcgtcaatgaacgagcgcaaaacggcgtacacaaacaaaggaaaaataccgagggataaaaagcctaaaaagtgtttggcgatcgtccggacacgaggttccaggcccaaatgtcccaagatcatatcaacggtgaaaaagccgaccaggataaccgccgcactgagaatggccgctacataaacggcctggatgacggaaaacggcacttccttttgtctgccggctccaaacagctgcgaaacaacgggcgtaacggccattaatattcctgcaaggcccgtatacaccggcgtccacaggcttgaaccgattgcaacaccggctaaatcggcggcgctcactttccctgacatcaccgtgtccaaaaaggtgatcagggcaaggcccgcctgtgtgattaaaatcggaatgaagatatgtaacagctgtctgaccttttggccgatcgtgttcgtttctctcaatttaggttccccgtttctttattttaacgagagaaattataacattttatgtataaaaagcaatgaaagccggcctactcttttttatccggtttcggctttttaaacatcttggcataaatgaatgaaagtgaaatgacccctaaaaaggtgcagatatattgcatcagccgtgcaaattccatatgatttcgcctcctttcatgattatggtgtacacagcggcgcatatccatgcgcgcgatgcagaaaataagggaaaggagatgatgtgacatgcgccacactcaaatgacggaaagcgcgtttaccgctgccgttcaaacgtacttgaaacaaattaccgaggatgccggaatgatactgcggacattggatgaaaaagaccaatgccttctttgcgaattagatgaactgggacatacgtttcaggaaatgcaggctgtcgcttcgtcgttttacctgcagtcatatatcgaacattttacgccttcctatacagagctggcgagggccgtgcagcatctggcggaagaaaagcacggagcgctgattgtgattgaacgtgcagatccgctggacggaatgatacaaaaagggaccagcctgcatgccgagatcagttcagctttaattgagagtattttttatcccggcaatccgcttcatgacggagccgtattggtcagagaaaaccgggttgtatcagcagccaatgtgcttccgctcacaacaaaacatgtcgatctcaaatacgggacgcgccacagggccgcgatgggactttcggccgtgactgatgcactcgtgctcgttgtttcagaagaaacgggaaaaatgtcttttgctaaagacggcggactgtatccgcttgtttcgccgcgggcgcttcatacgaaataataagaaaatgggaatattgtacccatttaatattaataaggtgaacatctttacctttttctgtattggtgttatcgtttaaatatacataaaatttaaaagaatagggagtggaaagatggcaaatgtattgatgatcggctttccgggagaaggccatatcaatccgtctttaggcgtcgtaaaagaactgaaggcaaaaggggaacatgtcgtatattacggcgtgaaggaatatgagcacaaaatcgcgtcaagcggagcggaattccgtgaatgtgaagatttccgaaaagatgaattcggaaaaaacgcaacgggtgatgaacagcgggatgctaccgagtttttactgttaatgattgagacttccgaaaaagccgcactccgtattcttgaggaagtaaaagatgaatcatacgactacatcctttatgatcatcattttctggcaggaaggcttgtgagaaataagctgaaactgccggcatattcactttgcacaacatttgcaatgaatgaagcatttattaaagaagtgttttcaaatacaaaccttatatcagaggaatcatctcattatccggcttataccgaagcggtcagccggcttaatgaagaattcagcgcagacattaaaacgccgtatgatattttctcaaatgacggcagaaaaaccatcgtatttacttcaagagcgtttcagccgaaagaagaagagtttggcgattcttatctctttgtcggtccgtccataactgaaaggccggcggctcaggatttcccgtttgaccagcttgaaggagaaaaagtcctgtttatttcaatgggcacgatttttaacaatcagaaggaattgtttaataaatgcttaaaagcggtcaggaactttaacggaaaagccgtcatgtcaatcggcaaacatcttgatccggcggagcttgatgaaattcctgagaatgttattgtaaagccttatgttccgcagcttgagatcctgaagagagcggacttatttatcactcacggcggaatgaacagtacgagcgaagggctttactacaaaaccccgatgatcgtcattccgatgggagcagatcagttcgccgtcggaagccaagtggaaaacacgggcgcgggcaagatgtttaaaaaagaagatgtaacagcggaactgctcactgaagcaataaaagaattgagcgaaaatcctgaatatcagacaaaagcttctgaaatcggagaatccctgaaagcggccggcggagcacagcgtgcagcggaattgatagcagaagacgtgaaaactgccgagacccgggttctgtaatcagccgtcacccgcttcctttataggaagcgggcttttttttgtttgtttttcgggaggattttcacgccgtgaagagaattgtatgaaaaacagacaagaaaggtggaatgtcgcggaaaaaagccatgttatgaaaatgattccaaagtcttttgtgaaatgttctcaatttatgtaaaatgtgtggcattggtgatgatctaagaccaaatgaatcggaattaatgtcgacttctgaatgaatcctgcataacaggcggcgtccaaagaaaaggaacgtccctttcagcaatgataaataggaggtttttcgttatatgaagaaaaaaatcgcagccggactggctgtatctgcagtaatgacttcaaccttcgccgtgcatcccgctgaagcaaaaaccattcaagtaaaaagcggcgactctctttggaagctttcccggcaatatcatacaagtatttcagccctgcaggcggaaaataaactgaaatcaacgatactccacccaggacagcggctgcacattcccgacgggagcggcacacataaaacggggcaaaaaggaaaacgaaacactggtgcttacacagttacatacggagactcattatgggtgatcgctaaaaaataccgaatgagcgtttctgaactgagaagcctgaaccgtttgagttcagatatcatctatccgggccaaaaactgaaaattaaagggtctgccggcggcacggacggaggcggcagacagacaaagcctgataaaggcgcatcagggacttacactgtgaagccgggtgactcgctgtggaaaatcgccaatcaaaccggcatcaccatcgccgaactgaaaaagctgaatcaattaacatcagacatgctgtatccgaatcaagtattaaagatcaaaggttcttcacataacggaaacagcggcacaacaccgccatctcattcaaacccttctgagaagccatccacttacaaagtaaaagcaggcgattccctctggaaaattgctaatcggttcggcatcaccgctcagctcatcagagaaaaaaataaactgacaactgatgtgcttcaaatcggacaggttctgttgattaacggaacgggaaaaacagaagatcctgtgcggcagccgggtaacaaaccggcaaagccaaacaagccaaatactcccgaacctccggtgacagggtcaaagattgacagaatgataggcgaggcgaaaaaacatgtcggcgtgccttaccgctggggaggcaatacgcctgcgggcttcgattgcagcggttacatctattaccttttaaataaggtaagctctgtttcccgtctgagcacggccggatattggaatacgatgaaacatatcagccagccgtcagcaggcgactttgtcttctttacgacatataaagcgggcccttctcatatgggaatgtatttaggcggaggagattttattcacgcaagctcctccggggttgaaatttcaaacttaagcaatccatattggaaaaaagcttatttaggagcgcgcagttatttttaaaaaaaagcctttcggggctttttttgtttaccattttcacgttttgacaagactgatgggtaaaaaaataagggggaggaagcatgaatcgtctcttgctttttctcatgctcgcatcaattacgctttgcggctgcggggcgagacccgctcctgctccgcccaaaaaacatggggaaagccgcgcattggaagcatctgcataccgtgagcatgccggactcatcaatcaaaacggaaaaacgatcggatatatcgaagtgagggaatctgatgatgaaggatcagacattcatatatcagcgggacatctgccgcccggcgcttctctcggatttcatatttatgaaaaagggacatgtcaggcacctgatttcgaatcagccggcggtccgttcaaccctttgaacaaagaacacggcttcaacaatccgatgggtcatcacgccggagatctccccaatcttgaagtgggggctgacggtaaagtggatgtcattatgaacgcgccgcaaacttcattaaaagaagggagcagactcagcctgctcgaccgggacggaagcgcgttcgtcattcatgaacatacggacgattatttaacaaacccgagcggaaattccggagccagaatcgcctgcgctcccctgacaaaaagcgcccgcagggaatgagcccttttgtattgagtatacaagggcttttttagtatactcggttatggaatacaaatggaaaggaaacatcacctatgacttcagaattacagcacctatcacttccggaagatatacaaaacaaactgcaggcttatcaaaatcatcccgtttcccaagaattccgggatttaatcggatcatcaggctatgaggccgaagataaagcgattgtattcgatgccgtcatcgctttgacaatgggaaaaaatatcttattaaaaggaccgacgggttcgggaaaaacaaaattggcggaaacgctttcgaactattttcataaaccgatgcacagcgtcaactgctccgtagacctcgatgcagaagcgcttgtcggctataaaacgattgaaaatgaacaggggcaggcgacaattgaattcgttcccggacctgtaacaaccgcaatgaacgagggacattttttatacattgatgaaatcaatatggcaaagcctgaaacccttccgattctaaacggcgtgcttgattacagaaaaatgatgacaaatccctttacaggagaagtgattaaggcaagcgaaggattcggtgttatcgccgcgattaatgaaggctacgtcggcaccgttccgctgaacgaagcccttaaaaaccgttttgtcatcattgatgttccgtatattaaaggaagcctcctgaaacaggtgctgacctctcagtctgtcttaaaagatgagaaattaattgagcgctttatgacgctgtcttctgatttaatcgcacaagcgcataacggacaagtgtcagaagaagcggcgtccatcagggctctcatagatacgtgcgacttggctgcgtacatcccgccgaaacgggcgattgaaagaggcatcgtggaaaaacttgacgacgacagggaaaaagccgctgtcagaaatattgcagaaacgctgttcgaatgagggatatacaatgaagtttatcaaatttaacgacagcacgattgattcgtttttgttcatgatgctgactgatctggccaaaacactgaccagaagcagtgaagttgaagtggaatacggcgtgcagtcttactacaatccctttgaaaagaaaatttacatgagccacttttggaaagaccgatcagccggggatatggaagccggcctgaaaagcgatgtctatttgcgcgctgtcggaacacgcagcagctcatttcgggtatttgcggggtttttaaatgacgttcaccggcacttcacccgccaaagctttgccaagcagctgtttatgctgcttgaggatatcagaattgaagagcagatcaaaaaagaacggccgggaacgaaacgtgtttttcagaagcggagggagatgtacaggaaatatttcacgacgcagctgacattgaatttagaacggagcattttcaccgacgctttgtattgcgcgatgtttgtcaagctgacggctgagtctccgcttgaaggcattccttccatgcatgaaaatattgatatgatgataccgtatattgaacgtcagctcatccgggtgtatgaggcggattctacggaacaaatcgcaacaataacggaagacctcatggaaggccttgatgaagtgcttgagaaagatatgctgaacacatacttttttctgccggaacttgattacgaaaaagcggctgaagagcctttattcgaaagcgtaaaaaaagcgccttcgttaagtgacgatctcacgctccctgagtcttccgacggagatgaagaaatccttgaagagaaaatgaatacgtggcaccgggaaaccgaagcgccgtcaaaaagcttccttcaatttgatattgagcacggcgcgaaatcagatcttgggaaagacgcggccagagaaggcgatgacggtgaccaggcgctcggctccgttcaaggttccgcacgtcagacgaaaagagaggattactctaaactggaagcgcttgaatccattcaggatgaacatgagggcgccgggctggctgacggaaaagaaaacaaatttgccttcccggtttatcaaacgcctcaaaaagcgtctcctgaagaggagcagtcttataaagaacaggcaaaaacgatagaatcatatcaaaaacgcctgaagcagatgatacaaaaaacacttgagcacaaaaaaacgctcccgcggaccgaccttcacgcaggccggctgaatcgcaaactgatccgctattttacggaacggaacccgcgccttttctataaaaagcaggacccgtcttcagacattgacgccgtttttacattgcttgtcgattgttcggccagcatgtttgacaaaatggatgaaacaaaaagagggatcgttctttttcatgaagccttgaaatcagtgtccgtccctcaccaaatcgtcggattttgggaggatacaaacgaagcgaccgaaacgagccagccgaatttcttcaataccgtcattccgttcgaagagtcgctgctgcaggctgcgggtccgctgatcatgcagcttgcgcctgaagaagataacagagacggatacgccatcagacaaatgacgaaacagctgatgcggcggagtgaggcgcaaaaatttttaatcgtgttttcagacggagagccggcagcattcggatacgaacaaaacggcatcgtcgatacgagcgaggctgtcatcgaagcgagaaaaaaagggatagaagtcataaatgtttttctgtccaatactgcgatagaagaatcccagatgaaaaccattcaggatatgtacggaaagtacagtatttttgttccggatgtcgatcagctgcccgatgtgctgtatccgcttttgaaaaaactgcttcataaaagcataggataggctttttcctatgctttttcgctttttattttaaaatgatttaattttttcggtattgatctgttttttttactattttgtgaacaatcaaggtagaatccaaacgcaatcagtggtaaaatatccttggaagcgtttttattacataattttgggcacagcgttcaaaagttatttcaagatagtgaattgatcacttgattatctaggttgggggtaatattcaaatgtttcaaaataatatgaaacaaagaatgaattgggaagatttttacggaccgaacctcggctacgcactggagctgtacgaccaatatgctgaagatccagacagcattgatccggatctgaaagacatgtttgacgaactaggcgctccgccaagccaaataaaagaggcatcggaaacaaaggaacagggacgcgtcaccgcagatctgattcaaaagatcgcagcagcagttaaacttgcagaagatattcgaacctatggccatctgaacgcttccgtcaatccgctcagaaaggatccgaaaaagagcgagctctttccgttatccgagtacgggcttacagaagaagaaatgaaagcaatacccgcgtctgtcatctgtaaagacgcacctgccaatataacaaacggcttagaagccatccagcatttacgcaatacctataaaagaaccatctctttcgagtttgaccatgtgcatgatttcgaagagcgcgcatggattacaaaaatggtcgaatccggcgaactgttccggaaaaattcaccggaaaaactgtcagccgttttagaaagactgacggaagtagaaggatttgaacaatttttacaccggacattcgtcggtcagaagcgtttctcaattgagggattagacgcgcttgtgccggttcttgacgacattatcgcccagtctgtgaaggcgggcacaaccaatgtcaatatcgggatggcgcacagaggccgtttaaatgtgcttgcgcatgtgctcggcaaaccgtatgagattattttctcagaattccagcacgcgccgaataaagaccttgtgccgtctgaaggatcgaccggcatcagctacggctggacgggcgatgttaaataccacctcggtgcagacagacagcttcaggatgctgaaaccaaaagcgcgcggattacgcttgcaaataacccgagccacttggaattcatcaatccgattgtggaaggaagcacgcgggcggcacaggaaacaagaacgcaaaaggggtacccggttcaagacgaaacaaaatcgctcgccattttaattcacggtgacgcagcgttcccgggagaaggcattgtcgccgagacgctgaacttaagctcactgaaaggctatcaggtgggcggggccattcatatcatcgccaataatatgatcggctttacaactgaaagcgatgaatcacgatccacaaaatatgccagtgatttggcgaagggctatgaaattccgatcgttcacgtcaacgcggatgatccggaagcatgcctgtcagccgttaaatttgcggttgaataccggaagcggttcaataaagatttcttaatcgatttaatcgggtacagacgatacggccacaatgaaatggatgagccgtcaacgacacagccgatgctgtatgatgccgtcagaaaacacccgactgtcaagcggatctttgcggaaaaactcgtaagtgaaggactgatcagcgaggaaaaagcgcaaaacatcgaaatggcagtgacaaaacgaattgaagacgcctataaaaaggtgcccgccaaaaaagaagacgccgtacgggaaattgaattgccggagccggtgtccaacggttttccagacgttgacacagccattgattttgatgttctccgcaagctgaatggcgaacttatcaactggccggaatcctttaacgtgttcggcaaactgaaaagaatcctggaaagacgtgcaaaagcgtttgatgatgaccgtaaagttgaatggtcattggctgaatcgcttgcgtttgcttccattttgaaagacggcacgccgatccggctgaccgggcaggattcagagcgcggaacgttcgctcaaagaaaccttgtgctgcatgacagcgaaacaggagaagaatttgttgctctccatcacttagacgactgcgcttcttcatttacggtgcataacagcccgctctctgaaggatcggttctcggctttgaatatggatacaacgtgtattcgcctgaaacgcttgtgttgtgggaggcgcagtacggggactttgccaatgcggctcaagtctattttgatcaattcatatctgcaggacgggcaaaatggggacaaaaatcagggctggtcatgctgctgcctcacggttacgaagggcagggccctgaacactccagcggccgcgtcgagcggttcctgcagctggcggcggaaaacaactggacagtggccaacctgacaagtgcggctcagtatttccacattttaagaagacaagcgaaaatgctgcttcgtgaggaaatccgcccgcttgtgatcatgacgccgaagagcttgctgcgcaacccgaatacggtatctgaagtgcaggaactgagcgaaagccgattcaagcctgtctatgagcagtccggtctttcccatgcttacgaaaaagtgactcgcgtcgtattatcaagcggaaaagtgtcaattgatatcagcgatcacttcaacaaaatggaaggcgataaggattggcttcatattgccagaatcgaacagctgtatccgttcccggcaaaagatacgaaggagcttttcgccaaactgccgaacctgcaagagatcgtttgggttcaggaagaaccgcagaacatgggggcatggagttatatcagcccgtatctgacggaaattgcgccaaaaggagtaaatgtccaatacatcggccgaagaagacgatccagtcccgcagaaggagatccgacagtccacaaaaaagaacaggaacgcattgtatctgatagcttgactcgcaaaaactaagggggaaatgtaaaaatggcggaaattaaggtacctgaattagcagaatcaatctcagaaggaacgatagcccaatggttaaagcagcccggtgattatgtagaacagggtgagtacttgcttgaactggagacggacaaagtaaatgttgaattgacagcagaagaatcgggtgttctaaaagaggtattgaaagattcgggtgataccgtccaagtaggagaaattatcggtaccattacagaaggcgctggcgaaagttctgcacccgccccttcagaaagtgctccagccaatgaacaaacgaaagaggaagcaaaagctgaacctgctgcacaagaagtcagccaggaagcacaatcagaagcgaaatccagaacggtagcgtctccggctgcacgcaagctggcaagggaaaaagggattgatctatcacaaattccgacgggggacccgctcggccgcgtgcgcaaacaagatgtggaagcttatgaaaaaccggcttcaaaacctgcggcacagccgaaacagcaggctcaaaaaacacagcaaagctttgacaaacctgtcgaagtgcaaaaaatgtcccgccgcagacagacgatcgcgaaacgattggttgaagtgcagcagacttctgcgatgctgactacatttaacgaagttgacatgacggccgttatgaatctaagaaaacgccgtaaagaccaattccttgagcaaaacgatgtaaaactcggtttcatgtcgttctttacaaaagccgtcgtggctgcattgaaaaaattcccgctccttaacgctgaaattcaaggcgatgagctgatcgtgaaaaaattctatgacatcggtatcgctgtcgcggctgaagaagggcttgtcgtcccagtcgtacgtgacgctgaccgcctgacgtttgccggcattgaaagagagatcggcgaacttgcgaagaaagcgcgaaacaataaattaacattaggtgagctgcaaggaggctccttcacgatcacaaacggaggtacattcggatcgcttatgtcaacaccgatcctaaacagccctcaggtcgggatcttaggtatgcacaaaattcagctgcgcccagtagcaattgatgcggagcgctctgaaaaccgtccgatgatgtacatcgctttatcatatgatcacagaattgtagatggtaaagaagcggtcgggttccttgtcaccattaaaaacctgcttgaagatccggaacagctgctgctggaaggataatttgaaacagacaaaaagtacactgcccttacaagcagtgtacttttttattgagcgaaggggagaatttatatgaaaagctgttatccgcttgagatcgaatttgaatataatgaagaattgcattctatcactccggttcttctgcaagacgaacatgacacgatattaatagactgcggatatcccggttttacaaaccatcttcaacatgctgctgcccggcatggaatgtcgcttcattcattgacaaaaatcattgtaacgcatcacgacatagaccatatcggctcactcgctgcattacatcgtttgcacccggatatcagcgtgacagtacatgagcgtgaagcgccgtatattgacggctctaaaaaatctttacggcttgagcaggctgaatcaacgtttagttcattgccagaggatgcaaagccttatgcaaaacagttcatttgctcgcttcaatcagtcgaatcggctccagttcaccggacagttactgacggtgagctgctgccttggtgcggaggcattcgcgttgtagccacgccgggtcatacacccggccatatcagtctttatctgcctgccgaaaaaacaatgatcacaggtgatgcggtcgtcattgaagacggaaagctgaaacttgctaatcctgactatacgttacatatggatgatgcggtccgatctgtgcagcggctgcttgattacgatatccgccaattgatttgttatcatggaggtttatttcagggggatgtaaaaaaagcgcttttgcgcctgtttcgtgatctgcagaataatcaaggataggagcggcggcagcctatccttgttcagttatgaaaacggaatctttgccgtttcttcttcggcgctgtttttctcttttttcttagaccagtaggtggcaagaacagaccccgacagattgtgccatatgctgaaaattgcgctcggcacggctgacaaaggggagaaatgcgctgtcgcaagcgctgcgcccagtccggagttttgcattccgacttctatcgcaatcgctttttgtgaagcataatccattctgaacagctttgcagtcaggaatcctaacaaatatccgattccgttatgtaagatgacgacagacacaatcagcagtccggattgaagcagatgctcacgatttacgctgacgacagaggatacaatcgctacgatgccgattaccgatacgagaggaagtgcgtgcacggcttgtccgacctgttttttgaagaacagcttcacaatcaccccgaggacgatcggcaaaagcacggcttgcataatggaaacaaacagtgaaccgaaagaaacgggaagccactctttcgcaaacagcataataagtgccggcgttacaataggagcaagcaatgttgagatcgtggtgaccgcaacagaaagcgccgtattgcctttcgccaaaaacgtcatgacatttgatgccgtaccgcccggacagcatccgaccagaatgacgcccgcggcgatttctgcggggaggcggagcccgactgataaacagaaagccgcaagcggcataatcgtaaactgggcagcgactccgatcacgacatgccaaggctttctgattaattctttaaaatcgtctgcttgaagagtaagccccatcccaaacataataataccaaggaaaatcgtcatataagaactgatccaagaaaacaaatcagggcaggcgaatcccaaaccggcaaagacgataacccacaagccaaaggtttggcccgcaaacccgcttatttttttcagccattccataaacacagctccttttacatccaatcaatcagtcagaaaatatgactgacttttctgtactccattataaataatattctgaataattcaatattaaatataagttttcgataaaattattatgtaaactaatatcttcttgactattcagacatatattcttacaattgatttttatactgaaatgaattgggagtgctgaagtgaaagaagctaatcaatggtcatctaagctgggatttattttagctacggccggctctgcaatcgggctcggcgcaatatggaagttcccttacgtagcgggaaccagcggaggcggcgcttttctgcttgtttttattttatttactgttttaatcggactgccgcttttgcttgctgaatttattatcggcagaaaaacacaaaaaaacgccgttgaatcctataaggcgctggcgccggggaaaaagtggcactggatcggatatctcggaatcataacgtgttttattctattatccttctacagcgtagtggggggatggatattaatctacattataaaaggctttacaggcggtttaacgctttcttcgggatttgatacgttatttatcgataccatttcaaacccttatgcagcggttttcggtcagctgctgtttatcgtgctgacgattttagttgtggcaaaaggggtgagcagcggcatcgaaaaggtaagccaggtgctgatgccggctctgtttattctgtttattcttttaatgatccgctccgttacgctgcatgatgcagcgaagggattaaaattcttcttcatgcctgattttggcgcgatggatgccaataccattttatatgcgatgggtcaatcatttttctcgttaagcgtcggagtgtccgtaatggttacatacagcgcatatttagaaaaagaagaaaatattgttcaatccgccgtatcggtgacggtattaaatgtccttgttgccgtgatggcgggagtggcgatttttccggcggtatttgcattcggtctcaagccggatcaaggtccgcagcttttatttaacgtgctgccgaccgtctttaaccaaatgccgttgggcatcgtgtttttactcgcctttttgctgctgtttttatttgcgacgctgacatcggctttttcaatgcttgaaattttagttgctgttttgtcaaaaggcgattcggcaaaacggaagcggtatgcatggatcgggggacttgctatatttattgtcggggtcccttcggcgctgtcgtacggcattttgagtgatgtttctatttttcaccgcagtatttttgacgctgcggattttctggtcagcaatgtcttaatgccgttgggcgcgcttttaattgccgtgttcgtaccgctgaaaattccgaaacagatgctgtttgacgaactgaaaagcggttccggtataaaacgaaaatggtttgcagtctggctcctattaatccgttatgtggctcctgtagccattattatcgtttttctgcacgtgcttggtattttttagaccaaaagaagcaggcccccgttcaagacgggggccttttttaataaagcggccacatcacgcggtgcgcttgctcgaaccgtttctccgcctcccgccaatcaacgacattccaccattgatccacgtaagccgcgcggtcgtttttatattgtaaataataggcgtgttcccatacatccagcggaagcaaaggaatgacgtcccattggctgtagagctgatgcttctcagcggccaaaatctccagccgcccggagcgcggcgcccagacaaggatagcccagccgactccttcgactttttttgctgcttgagaaaattgctctttaaaagcggaatagcttccgaatgacacatcaatcatttgaaagagcgcacccgtcggccgtctttttccgtttggattcatggaaaaccaaaaaatactgtgcaaataatggccggcaccgtgaaacgccaattgccgctcccaatgcgccactaagtcgtactgtttcgtttgtctcgcttttttgagctccagttctgctttattcagaccgtcaacatagctctgatggtgtttagtatggtggagtttcataatctctcttgaaatatacggttccagtgcggaataactgtatggcagtttagggaggacatgcttgccgatcggcacataggctctgcgctcatccggctcttccggttcggtaatgtcccggtaaagtgctgatgcctgttcgtaccattccgcctccgttaatccatcatcctgaagggtgtgaaaaatccggtcgatttgtgccgcgaagcgatcgaaccgaccttgctgtatgacttgttccttcaaggtttcacaccaattcagcatttcggtttgataagcgtgccgtttcatttttcttcctccttttcactcactttcataaaagtgctgagcgcaagcaaagaaaacacatacgggtagctgtgatacctgatgtaaaactgtttcggcaggccgattccggtcggatagctgaaagcgtctccttcgtaatgccggttttcaataagaaaagatatgccttttgtgacggcttgatgatgaggtttttcgtattgcagcaaagcttcggccgcccaagccgtctgtacaagcgtcccgtaagaaagcggaacataggttttgacttctgcgcttttacaggattctccccagcttccgtcctcgttttgaatggacttcagccagcggatcgcttttttcacggccgggtggttttggctcacgccgcaagccttcatccctgtcagcgctgcccatgtgccgtaaatatagcagacaccccatctgccgtaccacgatccgtcctcttcttgatggcggatcagccattggacggccttttcaatctgagggtgatcaggagaaagccccgcttctcctaaacagtgcagcacccgtccggttaagtcgcttgttgaaggatcgatggcagcttcctcagccgattccagcggcagcaggcggaccagcggatgattgacatttttctcaaaagcagagaagccgccgtcactgttttgcatggacaaaagccagctcagtccgcgttcccatgaggcgggataacgttttcgcgggatggctttgagcactgcggctgtgtcatcacaatcaggattatttgtattaatgtttgaaaaaccccatcctcccggttcagcatgcgggttgtgaacggcccaatcagcgactttcgtctgctgccgttcacgcagaaaccgggcggctccggttatcatttgatcgttatctgagatgccgcttttcataagcgcatagctgagaagcgccgtatcccaaacggtcgacgttgaattttccaggtacggtatatcgctgcaagacgtgagcaaagctttcgtgccggcaagcgcttttctgataacgggggagtggcgcgatacaccgagagcgagcaggccgtacaccataaaaatagtggcactcgcatagctgtataatgtgccgtcttcttcaatccggtcaagcatatacgttttggccgtacgcagaccgagctggtgaaaagcggcaggaatctgcaaaagccgcttccagtgcgcgaaaagagaagagaggtctctgttctcatcatgatcggaacgaagccatgtaaacggatttttagtcatatgccgatctaaatgcgcgagagacggaacattgggatttttcagcgaaaatcttttgttaagcgtcacggccatcggtacgaaatgaatacgagcgtatgtactgaactggtaaaaatgcagcgggaaggatgggggaatgactaagaaagataatggcagatgcagcgcgggccatgggtaaaggccgtttgccgcaagcatccactttgtcatgaagtgtacgttgcgcaagccgccatttgagatgataaagcgttcagcctgaatcatatgcgcctcagaacggctatataaaccggaagccagcaagccggcatagccctgtacagtagcggtcacatttcctttccggtcatcaggatagttggcaaaagttccgtccgggcgctgtttagcgcgaatgccttctgcaagctcagcgatcagttctttatcattgtctccaagagaagtgagaaggaggatcagaaaggcgtttgtcaaaatcggaccttcaaaacaaaatgaccatgagccgtccgcattttgcgtttctcttaatagggagatggttttcttttggcggcttctgacgttttcatgaattgtgctcacactcgctcaactccttcagaagcatatatattcatatgtaaaaggcggcatgacaaaagaaagaaactgctgacaggcagcagtttcttgtttgatttaatcttccaggttgatccagacgcttttcacttctgtataattattcagcgcgtaagagcccatttcccgcccgaggccggattgcttatagccgccgaaaggagatgccgcatcgaaaacattgtagcagttgacccaaacggtgccggcttggagacggtcagcaatgtaatgagcgtttttcacattttcagtccaaagtccggctgcaagaccgtattccgagcggttcgcccgctcaatgacttcatcaaccgtatcatacggaatggcggctaagaccgggccgaaaatttcttcttttgcgatggtcatgctgtcatccacatccgcaaatacagtcggggagacaaaatacccttcttcaaacgggcagctgccgcccgcgacagctttggctccttccgcttttcctttttcaatatatgaaagcacgcgctcatgctgttcctggctgacgagcgggccgatttgtgtatcttggtgaaggccggcgccttgctgaagcgatttcgcatatgaaaccatttcgctgacgacctcatcatatttgtctttgtgaatgaagacacgggagcctgcgcagcatacctgtccctgattaaacatgaccccgtttaaagcgccgggaatggctttcttcaaattggcatcaggcaaaatgatgttaggtgactttccgccaagctccagtgtcacgcgtttaattttttttgcggctttttccatgatttttttgccgatttctgtagaaccggtaaaagcgagtttatcgacatcgtcatggttggtcagcgcttccccggccgtctcgccgaaccctgggacaatattgatgacgccgtcagggaagcccgcctgatctattaattccgctaaatagagggcggtcagcggtgtctgctccgccggtttcaaaacgattgtgcagcctgtggcaagggcggcgcccattttccacatcgccataaggagcggaaagttccaagggatgatctgccccacgacgccgacaggctcatggcgggtgtaattaaaatatgagccggcgaccggaatcgtttgtccggttatctttgtagaccacccggcataataacgcatatgctcaattgcgagcgggatatccccattcgtcgtttcattaatcggttttccgttatcaagtgtttcaagctgcgcgagttccgttttgtgctcttccattaaatcggcaagcttatacatcagcctgcttctggaagcggccggcatagtgcgccattcgccgtgatcaaaggctttgcgtgccgctttcactgcactgtcaatgtcttctgtctgtgcctcgtaaagcgtcatcagcgtttctccggttgccggattcggtgtgacaaatgttgatcctgaagcgctcggaacaaattttccgtcaatataaagtttcttcgtaccctgtaaaaatgtttccagcctttttgtgatctgcatcgttaaagaactcattcgtaacaaacctcccgaaattttttatggtctgttttgagcatcttgatgtccgcgcaaagtaagcgcatacagtcattctataataacacccccggtaaaatcaatcgataaccgttattgcaattcacaagaaaaaacggctacaataagcttatcgattaagaaaaggagttttataaatgattcataataattggcagacaaaagaaagcgtcaaaaaggtcaaatgcgtacatacagatgcgaaaaaatacattgtcaaaaatgtgctgacgccgggtaaagagtatgaagtcaaaaatgaaacagaagaattcatttttgttgcagacaatacaaacaaagtcggaggcttctacaaagagtattttgaagaagtttaaggctgaatgaattcattttgcctgagccatactaaaaaagactacatataaagggtggctgcaaaatgaaaaaaacagagcaagacaaacaaaataaaacatcagatcagcttcagcaagtgcaacctgaagaaggcaccgacacgacgatggaacaaatttcagatacctataaagaaggaacaattgaagatacggatcgttgatgttttgttgaaaccgcggcattggagaagccgcggttttttatggcgaaaataaaaaactgacttttcgaaaaaaataccgttttcttgaaaccttttcttccgctgaaccgtattacttcataactgcggcacctttcgcgaagggcttttttgatgaacgttctaaaaatgtaatctgttcgtaatggtttaaatgccgtctatgtcgtattcttatatagggataaagaacttattttttatgattgtaataaaacaatagtatagaagcagaaagtggggttcttcattgggaattttttctgtcagcagatcaaccgacacaaaaaagctggaggctttgctcgttgagggagaacggatcgaaacgatttataaactgcgggttgaccaaatatgctttacgaataaacgagtgattttctttgataataaaatgttctccaaaaagaaagtgcgcgtatttcttccatataaaacaattgaaagcttcgccattcaagaagcggggatgtttgatcccgataccgggcttgtattaatgacaaggggaaaaactttcgaattggaatttgcaaaagaaacggacttgactgaggttcaagccatcttaacaaaatacttatgcagttaaatatcacataaaagccatccgaatgcatgcggatggcctttttattatataatgcttgtttttccggagttcgaatcaatgagatccgggtcagcgatagaactgatggggatataaatcggcgccaaatcaccattttcttcaccgaatccgtagttgatcttattggataaaaaataatcgatttgctgatacgggccgatcgtaatggaagaaccgcggtcgaccgcatttactttaaagcctcctacatttaccaaaaccggcgaaaacatcataatgggcctccttttccggcagggattttgtcgcatgcagactcaaaggttgatggagaatcaatttgatcccggtcatccactttgccgttcgtgccgatgaagccgcttgcatctccgaagttctgtccgtatccctgattctttttatcagaattctgccattccgccagtaaattttgtccgacattcaccgctgaagcattttcaaaggaattaattttcaacatgaaaatattaatattgatatatggagttggttgaaccacaggcaaacctcctttaatacaggtgtatgccggctgttatgaccgtatgcttagacagggggcgataaaaatggatttcgataagatgaagcaatggatggaaatggcgcaaaacatgtccggcggcgacttttggaaaaacgtttttgatgatgaacaactgaaatcatttcaaaacggccattctcattttccctttcaacagggagatgggcaaatgagaagaaatgaggatgcttttcctcttatagatattgtggaaacccatgatgagctccaatttttgctgtatctgcccggctaccggaaacaagatgttcagctgttgtcctacggagaatatattgtcgtaaaaggcacgagaaaatcctttttcaatgaacaggattttaaacagaagaccggaaaatacggcgattttgaaaaaaaactcgatcttccgcattccgctcaaggtacgaagggaatgcaggcggtattcaaagacgggattttatatatatcgattgctaaacatctgggggatgcaagccagatcattatcgaaggctgatcttgttcgctgtgccatctatcagatctgaatcatcgatactcatgatagggatggcgacaacggtgcaatcaccgttttgttcaccgtacccttcatttcttttattggctgctgtgtttctcaccataacggaagagccggtgttaaaagccgctccgccgctgattccgttcatttttatatactcaaagttgataacggatggaaaaaacatcatgattcgcctcctttttgtatatcatgtttatatattcgcaatacgggacgcatagaactttccaagagtgacggggaaagaagtgattttctttgaaaaaaataatgaaagagattttcaaaaaagtgtgtgaagaagaattagaccggcttaagaaagtggaacaacagcttgatgagcttcaggataagtgtcattttgagccgcaaacggttgaaggggaaaaaacatatgtccatattgagcacgtcaaagtggacaagattgaatacaatattgattttgaacagctgagtatagaagagctgagcggtatgctgaatatcggcgccacttaccatacaccggcgcacaggctcaaacaagcctgcgctgaagaaagtcgggacaacccgcaaaatgatgctgcgaaagaaaaaagacagacaaagcagcagacacccaatgtcaccatcagggggagaaagcattgacccccattgtttcatcctcctttttcgagggtatgtattaacagatgcagcgaagaatacagacgaaaaaggagatgatgaatatggcattatcaaaagaacagcaggacagcctttatcataaattaatcgatttaaaggaaagtcttcagggagaatccaaagaaaatcattcaatgagcgaagacacaggagaactgtcgaacggagtagataatcacttagctgatcacggaagcatttatttggacagggtcacgaatcagacgctggacggtgtcgatcagaatcttttagatgaggtgaacgccgcgcttgaacgaatggataaaggaacatacgggatttgcgagaaaacgggaaaagaaattccttatgaaagacttgaagccgtaccgtacgccagaatgaccgtcgaagcgcagcgagaaacagaaggggatgtgaaaacagacgctccgtcatatgaaagggaatttcacgagcaggtgaaagacctctcaaataaagaaaccgttgatcaaaaaagctcacaaacttacgaaatcctggatcgcgagcaggattcacaataatagcagcaggtacattcatatgtacctgtttttttattccataaaaaatctcagaatcgaaataaaatcattgactttatataaaaaagaaagtaacatactatttgtaagtaaatattaaaagattaccgggaggaatttagaatgtctcaagtattatttgtaaaatcaagcgaccgtacggctgaagaaggcgtatccgtaaaattatacgaagcgtttctggctgcttataaagaaaacaatccgaatgatgaagtgatcgaacttgatcttcataaagaaaaccttccttacctcggaagagatatgattaacggaacattcaaagcttctaaaggaattgaaatgacagacgaagagaaaaaacaagcgtcaactgctgacatttacttaaatcaatttgttaaagctgacaaagtcgtgtttgcattcccgctttggaacttcacagtgcctgctgtgcttcatacttatgttgattacctgtctcgcgcaggggttactttcacatacacgcctgaaggccctaaaggtctgatgggagataaaaaagtagcgctcttaaacgcacgcggcggcgtatattctgaaggaccgatggcatctcttgaaatgtcattaaacttcatgaaaaccgttcttggtttctggggtgtccaagatcttcacactgttgtcgttgaaggtcataatgctgcaccggataacgctcaagcgatcattgaaaaaggactgcaagaagcgaaagatctggctgcaaaattctaattgccataactcttgcgcccctacagggtgtgagagttttttctattatagaagaaactggcggcagctttcgattcaatcttatattgatatattgatattttgtcgaaaaaacaatttttatgtagaataaagcatttttcacaaagaaaaaaggttttctgtaaaagaattaaccctcttgccaaaatacgactgatggtgtaggatataagagaagctacattgttcgtattgttaattaagttttaacctttaagctgtaatagggagttttatatcgaagccggaatgtcatgcctccattgcagaggacgacaggaacgcttctgcaaacacccactttgaggagtggtggtttaaaactttcttacttgcgtacggcatacgtagcgaaagccatttcccttgcggagatggctttttattttgaattgcccttgagcagcgtactttatcagtatgataaaatgaaagaatcaaagacaaagtgaggttttacaacatatgctggataaagcccaatcccttctggcgcattattttggctacgacagtcttcgcgcgggccaaaagcaggcgatacaatcagttgcagaggagagaaaaaacacggtctgcattatgccgacggggggcggaaaatcaatctgctatcagattcccgcactgctgtttgaaggaaccacaatcgttatttcccctcttatttccttaatgaaagatcaagtcgacgcgcttgaagaagcgggtatcgcggcagcttatattaacagcacccagacaagccgtgacattcatgagcgcctgaccggtttgaaacaaggggcttaccggctcttttacatcacaccggagcgtttgacttcttctgaattcattcacatcctgcagaatattacggttcctcttgtcgcaattgacgaagctcactgtatatcgcaatggggacatgatttcaggccgagttaccggaatatcgaaatcctttttaatgaattaaaagaaccgcccgtcatcatcgccttaacggcgacggctacgcctgaggttcatgatgacatctgcaagcagcttcatattaagaaagaacaaactgtatataccggttttgccagagagaatttaacgtttaaagtagtaaagggcgaaaacaaagaccggtttatcgagcggtacctcgaaaaaaataaacacgaagccggcattatatatacagcgacaagaaaagaaaccgaccgtttatatgagaaattaaaacgcagcggcatcaatgccggccgttatcacggcggattggcggatgatgacagaaaagaccagcaggagcgttttcttaacgatcagatacaagtgatggtagctacgtccgctttcggaatgggaatcgataagagcaacatcaggtttgttttacacgcgcagattccgaaagatatggagagctattaccaggaagccggacgggccgggcgcgacggtcttaacagcgagtgtgtgctcttattttcgccgcaggatattatggtgcagcgttttttaatagaccaatcggccgccggagaagaaaaacaaaagcaggatctcaaaaaactgagacagatggtggattactgtcatacggaagattgcctgcagcggtttattctgaagtatttcggcgagaatgaggcggaagcttgcgaagcgtgcggcaattgcactgatacaaggaccgcccatgacgttacaaaagaagcgcagatggtattgtcatgcatcatcagaatgaatgagcgcttcggaaaaacgatggtggcgcaggtgcttagcgggtctaaaaataaaaaagtgctggaaaacggcttcagcagcctgtccacttacggcattatgaagcatcaatccgcagcggaaatcagtgattttatcgaatttcttatttcagatgaatatatcagaatggcggacggcacatttcccacgcttatggtcacccaaaaaggcagggacgttctgcttggaaaaagcgcagtcgcgagaaaagaagccttacaggccgccgccgtcaccgaaaatgatgaattatttgagcttctccggcgtctccgcaaagagattgcagctgaacagggtgtgcctccatttgtcgtgttctcagatcagacgttaaaagaaatgtcggcgaaacttccgaaaacagatcaggatcttctttccgtaaaaggggtcggggaacaaaaaagattgaaatacggagcggtttttttagaagaaatccgaaattatgtaagagaaacagagtgaaaaaaagtttttttagaaatttgcacattgtgtttttcatgggcgccggaaaaatcagaagcttgaaaacccttgctgtatcaaggtttcagcaagacttaccaagcgagagaaatgtttcatgtaaaggaactgtaatctaattcaaatcgttttgttattgaactgacattttcatatgttacgatatcacctgttagccgccaataaaaagctaacaagggaggatttacttatgaagaagacgattatgtcctttgtcgcagttgcagcaatttcaacaactgcatttggagctcacgcttctgctaaagaaatcacggtgcaaaagggtgacacgctctgggggatctcgcaaaaaaacggagtgaacctaaaggacttaaaagaatggaatcagttatcttctgatttaatcattgaaggagagaaactgactatttcttcagtagaaacaaccacatctgggcagtacacagtgaagcagggcgacagcctctggaaaattgctcagaaattcggaacatcagtcggcaatctgaaaagcttgaataacttgcaatcagatataatttacgcaggcacaacgttaaatgtgaaaggtcaggctcaggctcaggctgcacagccggctcaagaagccagccagccgcaaactgaacaaaaaccagctgctgagacagaacagccgaaacaagaagctgtcaaaaacgagcagcctaaacaagaacctgttcaagaacaacaacaacctaaacaagaagcgaaggctgtcgaagcaaaacagcagcctgttcaatcaaatacaaaccaacaagagcctaaaaagcagatgacaatgactgcaactgcttactctgctaacgacggcggcatttccggtgtaacggcaaccggtgttgacttaaacaaaaaccctgatgcaaaagtcatcgcggtagaccctagtgtcattccgcttggctctaaggtttatgttgaaggttacggagtggcaacagcagcagatacaggcggcgcaattaaaggaaataaaattgacgtatttgttgcaaagaaaagtgacgctaacaactggggcgtcagaacagtaaatgttaaagtattagactagtttcatatagagatgaagaacacaaggcgaaatgctttgtgttctttttttcttcccttttttgactgtatataatcgttatatgcggaaaaagaaaaagcgtttctctaatataataaggaatggatgtgaaaaaagaatcggaagggatgaatctgatggagccggaatgtatatgtttatggaataccttcacagaatcaccggtgtttcaagcaggtatatgcaccgctttcgccattgtgctcgttatcggactgtctatgcctgctgtcaggctgtttcaggcgcttgacagagggagaggaaggccagccgttattgaaaaggtgagacgtactggcgtgatgaagaatggcaggcacgagcttgtacttattttaaacgtaaaaaaccaagacggaacgcatgataaacgtgaactgacacacgccgtatataatgaagagatcagccgtttttatgaaggagcttccgtatgggtgagggcagcggctggcggacgaattatgatcgctcctcgcacgccgcggcataaggcgtcaaaataaaaagacggggcggttttcccgtctttatgtattaatgccgatcgatccatatccgtccgccttctgagccggcttctatcctgcatgctcctccgatcgggaatgtcatcaaaggggaggtatggccgaaatcagcatttgcgataacaggcatggatgacagttcttcttttgtacggatgacggcacgcagagcctcctcagacacatttgaagcatgctggaaacgtccgatgacaattcccttcacggctgaaaaagcgggaagatggatgagtgactgcaaatcccggtcaaacatatgaatgtccgacatatgatcatcttctataaacagaatcacttgttccatctccggaaagtattcggtgccctgcagaagattcagcgtgcatagatttcctccgatcagtgttccttccgcatatccgggctgaataacgagcggtcccggattccgataaaaacgtctgtcctcctggttcaaataccatttatcatcactccactcggatgaaggttttacctcatacgggttgtcagaagcacagcaggccaagaaagagtcaatcgtatagtccagcccttttttcatggcaaatgaagaaaaatggggaccggaatatgtaataaggccggttttttgatatatggcatggccgagagcggtaatatctgaatagccgcaaaggattttcggatgccgcttgatgttttcataatcaacgtagcggagcagctgatttgattggaacccgccgagtgtcgtcaaaatcgctttgatgtcaggatcagcgaaagcttcgtgcagatcccgtacacgcgattcaatcgatgatgaatgaaattcatttatttctttcgcattctctgaaaaagagacacaaaagcccagctcctccaattttgtcttcgcggcatttatattttcatctgacatagcggacatgcttgtggccggagacacaatacggatgccgtcgccttttttcaatttttccggatacaaaaaaaaccctccttaaatggtttaatctattacaccatattaacgagggtttatctatcattttttacaggtcgacccatttaatgccgcctgattgcgtatcattgtcaatccagacatcaaattgatgcttttcataaaaatgaacgagccggtcgacatgatcccaatcacgcttagcgatgtcgcccgtcactttcgggatattctgctctctggcgatatgttttaaaaatttcatgcagatcgagccgtagccgtggttcggcgggcctttaatatccccgatatgaatggcattgtcataataagaagcgatcagtgaaaaacagcctcttccccggtaggctgattcacaatcagtcagcataatcttacatgtttggccatcatcaatcgaggaaacaatgatccaatcgtcattgttcgattgatcaataccaagcactcgcgcgtcttttgatacatctatcagattttcccgcattctgaaaatctgaaattcaagtttatgaagctctttttccagctctttctgatctctttcttctgcagtaaacaaaatcatactcctttcacagcgtaaaagtcttagtcaaacacaagtatccattgtagtaaatgatgtcttggtttgtaaatgggttttgcaaaaacttttttagaaaagtctgccgtttatatgtggattgacgtttttaaggcggtggggatagggaaaggaacagtgagcagcggaaaaaggaggaatctataatggcaattgactcactcatcggcaaattgaagtacgtaatgacggaatctcctgataaaatgctttccttatatgtaaatacggatatgagaaatccggatcagcaggggggagagtggaaaatcgccttgaaaaccggttttcggagattaaaagagtatctgtctgtaagtgatccggaagaagaaaaatctctcgtccgcatcatgcaacgtgtctatcaatatatcgatgggcttggtaaagagatgccgcgaagcctcgtattttttgcatcgggggaaggcggtgtctgggagacgattgaattgcaggtgcctgtcgaaacacgattttattgggaagaaacggctgtccttgatcaattagaacttctccgtgaacaatttccaagcacggcttttattctcacccagcagaatgaagtgaagatcatagaaaccgtactcggaaaaattgaaggggtggagcattatcaatacgacgtcatcaatgaatcgtggaaaccgcaggatgtaagcggaagctccgcatcaatggacgaagacgccgccaaagcccatgtcgaagaaaaccaaaacaggctgtataaacgattggcttcaaaccttgatcaaaaggccgcttcacaccaatgggagcgtctcgtaatcgcaggggacaaagaaacagccgatattctcgatcagcatatgaataaaccgatagatcggatcattccaaaaaatctgttgaatgaaaacgaacataaagtgatagaagaactgttgaaggaagcataatatgacgaaaggccgggtctcaaacacccggtctttttagggcttaagtttgtctaatttctgacgaagcggacgaaaccgttgacatcaaagctgaattctcataccatttggatagtcagtaaaattgagagaggtcataagatgaatcagacagaaaacaaacctaaaagttataccggtatcgtgctgacattgaccgttttgatcaacgggttaattgcggtgctgttttttatgccgaaatcgggacaggtcagcattgccaatattcatattctgccgatgttaaatgctatttttaacagctttacttttatctttttgctggcagcgctctttatgattaagcaaaaaaatattcaagcgcataaacgctttattttggcggcgtttacgacgactctgctgtttttgatctgctatgtcgtgtaccactcgatagctgagaatactttattcggcggccacggcatcattcgggggatttatttctttattttgattacgcacatctgtctttccgccgttatcgtgccgcttgcgctgtttacgctgatcagaggattcagcatgcaggtggagcgccacaaaaaaatcgcgagatggacgatgccgctctggctgtatgtcagtctgacgggtgtcattgtatacttaatgatctcaccgtattattaaaaaaagccgtgctctgcgcggcttttttctattgatggaaaaaggcgcctcatcagggcgccttttactcttcaagcgtttcaagtgttgttacatttaaggattgttcaacggtttttgtttttgcttttactttttctgcgtacgtgtaatcaccatagcagtagggataacggaaattgtctttgttccctccgcaagtgtaaagtttcggattctttttgacctgctgctcggagtattgttttgccagttcctcagtatgcgatcctccatgttcagccacaaaatcaatatagccggctcccatgttgtagctttgtataatcgtatccaagtctacgccttttttcttgcctgtttggtacatgagagtgaattgtttgattccctgtttgatactggtttgagggtttttaatctcatttcgctttaaacccagagattctgaagactgcatgggatcatttcctcttccttttgactcctgatatatcatgccgagtacaagcgatgtatatttggtgagtcctttttcatccagctcgtcttcaacaagcggtttgtaatctgtcagccgttcaagcacgatcggtttgacatcaaacggaagacttttgagccattcattatttgaaaataacagaatgaggaagaaggaaaccatgacaaaaacacatatcatcataagacccgcggcagcgaaacagccttttttctttttctccactgtgtttcaccctcaatttcaggagcattatgactttttcattatgacacagatggatgcgcgaaaccaagcggaaacccgtatttgaaacataaatttaaaataacggttcttttgtcaggcgcaggatgtatctgcatcaattgacatttggtataattgggctacttgagaaaagaagggtgaggtatatgactgaatttcacgaatccggaaagacgaatgaccccgctgtcgatttagatgaggaaactttatttttggttgcccagacttttaaggcgctgtctgatccgaccagaatcagaattctccatttgctgtcacagggtgaacacgcggtaaatgatatcgcagaaaagctgaatttgctgcagtctaccgtttctcatcagctgcgttttcttaaaaatctacgcctcgtcaaatcacgcagagaaggaacatccatctattattctcctgaggatgaacatgtgttagatgtgcttcagcaaatgattcaccatacgcggcacgattaaaaaacatccctgctttttagacagggatgtcagccgtactgactgttattggtttggtctctgctcgtttttaaaacataaaaagagaagccgctgtaataaactgcgatgaaataaaagatactgatggtcagcggatcggccccgaccgtttggctgtatgcctccggatgggtaaagtccgctgtgacccggtaaatttcaataacgcgataaacaaatctcgataggaaaaacgttaatagaataagttcaatccacagatgagtgcgaaaatacatttttccgcggcgttcttcaaaagaaatattccgtttggcaaacaggaccagaagccagccgcaaaaagtgccgaatataagatggccgtataaagccgggtgtgtgatgctgaaaaacgccagagctgcggccagcaatgaaaacaaaatcattcttgtataaagccagcggggtttcaaaggctgaaagccgacggaccgtttcacctttttatacagaaaaaaggcaatcattaagacagggcagatgctttgaagtgtgatatgcatggtgtgaaactccccctccgttgagtagtgtatgcttatccggctggttttagtagtctgatttattcgcaggctgaaagcatcttttatcacagtatgcgcgtttcttttttttgcataagagaagcgcccgcgcctttttcaggatttaaacagaaaactcttgataaactaacggtattagttataataaaactaacgatattagttttagggggatgttgatgagaatcttacaatacggaagggtttggcagctgactttttttccagcgcttttcccggtgaattgttatttggtcgaagaagaagtaggagtaaccctgattgacgccggactgcctaacagtcataaaggaatcaaacaagcattgcggcagcttgggaagccgctgaatgacatattactcacccacgcgcacggggatcacatcggttcgcttgactcattagctgcggaatttccggatgcctccgtctgtatttctgagcgggattctttcttgctgaaaggtgacacttcattatttgagcatgaagcacaaacgccgataaaggggggagtgccgaaaaatgttcagaccgaacctgatcgcctgctgaaaggcggcgagcggatcggatctttacttgtcattcccgctcccggtcatacgccgggaagcctcgcttttaaagatatgagaaatgatatgctgatcgtcggagatgcctttcaagtacggggcggccttgctgtttcagggaagctgaaatggaaatttccgtttccggcttttgctacgtggaataaagaagaagctgtaaaaacagcaagaacgcttatcgctcatcaaccaagcagtctggccgccggacatggaaatgttctctgcaatcccgttgaaatgatggctgaggctgctgaggaagctgaacgaagcctgccgggaggccgatcataatgtcaccgagagtcggaatgagccttgacatgatattgagagccgcagcaggcatcgctgacaaaaaagggctgaacgaagtgacgcttgcggccgttgcaaagtccttaaacgtaaaaccgccttccctttacaattttgtcaatggccttcaaggaattaaaacagagctggctgtctccggtttaactatgttatttgaaaaaatggcggcctctgcagaaggactgacgggtgaaacggctttgctcgctcttgccgatgcctatatcaatttcgccgaagccaatcccggattatatgacgcaacatttcaaaagataaaagacggccggattgagaatctgtcaagcctgcttgtagagcttgttgtcaggcagctgacagctaacggttatgcacagtctgacactgcgattcatgctgcgagaggactgaggagccttcttcacggctttgccgtgttgagaaaacagagtgcatttgaattaaccgaatcaattaaggaaagccggaagtttgcagttgttgctttcctaagaggtttacagggtaggtaacaataatattattatgtaaactaaataaaaaaacgcatcagtaaaaggagggacaaatggattcattacaacatatcatttgtgagcggcgcacctattcacatatttttgattctcatgcacacacatactgccaaatgctctttccgctcgaaggacagctggacttggagacagaaagacgtgaaatcagattaaaacctgatcaaatgctgtatattccgcccgggcatgaacatcggttccgttctttggagcgaaacgaatgtctcgttctcgacataccggcatattttttcaaaggttcatttgatcccggcgttctgaataagcttgattctttttggacatcgattcggtttctgctgacagaagagactaagcagcagtcggctcattcattgagtctgcttgcagaatatattgctgaaaagatacaagaaaaccgtacgaatgattcaattgcgtatatccgccgaaatctctcaaagactttttcaattaaagagcttgccgcaatggaacattaccacccggcgtattattccgactggtttaaaaagcagacagggaaaagcccgcaagcttatattgctgagctccgtatgaagaaagcggaacaaatgcttattgaaacaaaatgccggctgacagacatcagtcaggaggtcggctttcaaaatttgtcttcctttaccagatggtttgtcagacataagggaataacgccgcgcgtcttccgaaacacctttcaatctgataaataatcctgaaaatcagttaaataaactgcgtctttttttggtatcatgattgtaaaaaaggagtttttgatatggcagtcatcgaagattttatcaagctcgatctcagaataggaacggtcgtaaaagcggaagtattcccggaagcaaaggtgccggccattaagatgacaatagatttcggcgaagagatcggcatgaaacaatcaagcgcccagattacaaaacggtacgaaccgggtgatctgacaggcaggcaggttaccgctattgtcaactttccgccgcggcggatcgccggatttaagtcagaagttctcgttcttggcggcatcccggaaaaaggagatgttgtcctgcttacgccagagcagtcagtaccgaacggaacgaaaatcggataataaaaaaagacgtttgcagaagcaaacgtcttttgcgtattgaggcgatacaccacacgccacattcgtgtgtgccgcaagggcatgtgcatcggcttacacaattcagctcatcgctatatgaatatagcatggccggtgtggaaatgcaagagattttttaatatatgttatatctggctttgttttgccgatccccgattccttcgtgtaaggttcgtttgaaattttatgatcttgaataaagcagttcgacaaatgcaagagggaatttgagcaagttgtgaccgaagtgtgacctggaattaaaatccgggtctttttgtgtaaaagatgcatgcgaagagaccatataggcattaaatgttattactgatgtcttcatttatcttttggctaagtttctgaaccttctctttaacatttgaaacagctcttttttgaatttcatcaaagttctcctgaatatagtccatgacacttcttattataacttcactttcaaaattgaatatctcatttatttctgactgttcttcatctgttaggtgatggtattgaagttgtttagcatttacttcagcagctgcatcaatcctaacttagttgttctggctgtacaatttcatattcaccttctgcatacttttgctccgcataatggtctccccattgacagagctcctgcaagataggtttaagagattctccaagttcagtggatgaatattcaaccttcggcggtacttggttatacatctttctgctcacaagtccactggcttcaagctctctaagtgtttgaatcagcattttctgagttatatttgggataatgcgctttaattcactcgttctcttcggtccattcattaaaaagtataatacaaggcctttccattttccgccaatcacttcctttgtcacttcaaacccacagctaaattttttcatgtctaaagctctccattccacatttattactttttagttactatatcacaaaaaagtgggtacttccgataatgtgcttactgaaggatactattacttgtaagttgttcttcaagtacttaaaggtactagacataaaataatattaattctaaaggagtgttaagtatgggtgaatttgaaggtaaagtagcgcttgtaacgggtggaacaagtgggattggtcttgctgcagcacaaaaatttgtaaacgaaggtgcatatgtttatatcacgggacgtagacaaaacgaacttgataaagctgttaaccaaattggcaagaacgtaaccggtgttcaaggtgatatttctaagcttgaagacttagacaaactatatgacatgataaagcaggaaaaaggtaagttggacatcctttttgctaatgcaggcatcggcagctttcttccattaggtgaaattactgaagagcaggttgatagaacgttcggcattaacgtgaaaggaaccatttttactgttcaaaaagcgttatcactattcccggacaaagtaggttctattattgtaacgggctccaccgctggatcaattggcaacccagcatttagtgtatatggagcatctaaagcagcattaagagcactggttcgcaactggattcttgacctaaaaggtactgaaatccgtgtaaatgtggtaagtccaggagtgattcttacacctgcatacgatgagctttttggtgatgcacttgaaggagcgatggaaaatgccagaaatactgttccagctggaaaagttgggacacctgaagaagtagctaacgctgtatctttccttgcttcagacgaaagcagttacttgacgggtattgaattgttcgtagatggcgggctagcacaggtataatttcactgcgcagaggttacaaatcttccccaaaaaaggttaatggggatttacttgaagaagccgtataaaaaagtcgttttccttaaaggacagggaattcgacttttttatgtttgaatttgattaacgttgtaaattcgcattttcctggggctgccactaaatgacctgtaaaaaagattactttgtgaataaatgtacttaaagtaacggaaaggagaatgtccagttgttatttggagtgaattcggtggctataaagaacttaattctgcccattttataaagttcttttatgaaagacttcatgaaatgaaagaaaatcgggaagaagatgaagactaagacgattaataaaagaaagctctcttttagagagcttttttcagattttcaatttttaacaggctttataatgagcaaacaggcattactcaaaatactcgccgcgcctatccaaagcagccattgtgttgcggtcagccatgaggcagttaggataaagagtccaatggcaattgatatataattgccggctcggtccagtttacgattgcaatgaagtttatatttagcatgagaaataaattgatcaattttatctttcagctcatagcatttttccttcatcttatcctcagtttcttttacttttcgataaagcatattattcatcgtttgcactcccatatcgccgttttgaaaattcagccatgattttttcttcatagtcatctgagatggattgtgcctggtcttcaactttcaaatgtgctttttcttcaaaaccgtcctgttcttcaccatcaaaacgataaagtttttgcaatagcctccagaatgtttcaacttcttcagttgtgaactcatgaaacatatccgctaaaaaataggtggatctttctgaacaggaaattaacgctttttttccttcaggggtaatctcaatattgattgcacgtttatccagtttgcttggcacagtgtgaacatatccttttttcgagagacttgaaattaatttgttagcggtttgttttgttgtgcccagctttttagcgatattcataagtgtggtatcttccgtcggtaaatgggcaatagcaataagagtcatgtgctgtcgggaagtcaacatttctaagtattcgtccccccgagtctgcaccttattgacaaccgaaaataatgatgcgtaactttgttgcataaaatgcagttccttcattagtaatttaatatccataagttatctcccatctaaattgtcaccatgttgacaattacaatatacatcacgaagggaaataagtcaacatggtgactaatagggcgggtacggctgttttcaaaaatgccacagacagtcggagtgtttacaaaaggggaaataagtataataaatgcgaaaagggcattaatccaaagtgggaaggtgtttgacattcagaaagtgaactggtcagaacggtatgaatggttcaataaacaagatgaaaaagatgggcgtttaatggcgttccttcgtcatgagcttacatatgaggaagtcatacggttatataagaaagggttttatttgaaatcaaaagaaggggatgtttcgttacgtaagaacgatatctgtcgtatgtttggggttgaagagaggcagtggggcaaatcttaatgaacgggaagagaaaaactcttcccgcttttcatagcagctgttattctttttccagcatggaagtcagccattctcttaatgccggtttctgcacataccgctttccgtttctcgtgatatgcggaatgtcagatattcatgaggatcaggtgagttaaagttttcaatccgtctccgatgaaatatccggctaaagcgattccaatgccggtaatatatccaaacctccaataaacgttatcattttttatacggtgaagccggccggaggattcagccttcagcaaaaccgccgggcgtttattgcggacggttttgattgctgagcttttccacctgcacctttccggagaagaaaacagcacctccgcccatatccgccagccgatcgggcgtgagtgaattgacgagctgttttttatcatccatatcggcccaaagaccttggctcaccgcaacgccgggaagcacctgttcgccgaccgaaacagtcaattcgcactctccgcggtgattccaaactctaacggtttctccgtcttctatgttccggtgtacagcctcttctgtatgaataaaaagttttggcgctttttccagttttacgtgtttttcgttatttgaaaatgtcgaatttaaaaaattatgattcggtcccgggacaaataaaagcggaaaatcgtcatcgctctcaagagggatgtgtgtcggcagcgccggataaccgtcctgtttcatcttttccgaatataattcaattcttccgctcggtgtcttgagctttcccggaaaaagcggttttttccgtttggctttcatgaaggaatggcttgagagcgcttcgtaatcaatatcctcgatatacggattgtcgggaaagtccagcgcctgtctgattaattcttcatcagaatcctgaagctcctgctcggtaaatcccattgctccggcaagcagacggaacacttccgtattcgatttgctgtctccgtagggttcgatcaccggtttttgcagctgaataaaatgatgccagtaagacgtgtaaaaatccgtgttttcaaaagcggatgaagcagggagcacgatatccgcatatttggcggtttccgttaaaaacagatcgtgaacgactgtaaataaatcctcccgcagcaggccttttctgactttattcgcttccggcgcaaccactgcgggattcgtaccgtaaataaacagggagcgcacgggcggttttgtttctaaaagaacgcttccgagcctgttcatattaaatgatcgcggcttccggccgtaaagcagatcaggccgctggagcgcttgtctgttatagtttaataccgcgctgttgtgcttgattgcgcctcctccggtgttgagccactgtcctgtaacagccggaaggcaggcgacggtgcggacgatcattccgccattgtcatggtgctgaatgccgtttccgatcctgataagggaaggggaggtttccccgtacattctcgcaaggcgtctgatatcgtcggctttaacgcctgtaatagcagaaaccgtttccggatcatagtgtttgacatgcgcttttaattcgtcactgccttcggtgtattctgtgagaaatgcttcatcgtgaaggttctcagcgaataagacatgcatgataccgagggcgagtgcggcatctgtgccgggacgaatgggaataaaccaatcagcaagccggccggtttggttcttatgtacatcaataacgacaatcttagccccttttttccgggctttttgagcaatcatgacttggtgcatattcgtgctgacggcattgattccccaaaaaataaagagcttagcatgtatggtctcctccggatcagtacccgctccttctcccattgtatagttatagccttcagaaccggctttgctgcagatcgtccgttcgagatgactcgctccgagacgatggaaaaaacggcggtccattccctctgccgccagttttcccatattgccgtaaaagctgtacggaagaatgctttccgctccttcttcggcaataagctctttccagcgcgaactgatcgtattgattgcttcctcccaggaaataggcgcaaacgcggcttcaccttttttaccgatcctttttaacggaacggttacgcgcttctcatcataaatacgctcagccatgtgtctgactttgttgcaaatattccctgatgtgaccgggtgatcggggtctccctgaatgttaacgatttttccgtctttttttgtcacaagcaagccgcattgatcgggacagtctagtgagcacaccgacttaaagaccccgttcggctgtgttgcagcagaattcatagcccatttctcctctttgtttatattgtaagcattataacatttcaaaatcgaacgtcaattcagaaaaaagtgttgacattacggaaagacttttctatgatgagtttattcttttaaacagcctgacaatttcatcattttattttctatccagagaggtggagggactggccctatgaatcctcggcaacatttattgtgccaattccagcaagcgtatgcttgaaagataggaaagaatggtctatacatatttgtgcgcttcaagcgtataaagacggtatatgaatctctttccttctttgaggaaagagatttttttatgaaaaaatttatgtgaaaaggatgttttgcaccatgacggttttaattaccgcgccatatcacgacgaggggctgaaggagctggctgagctgttcggccggactgtgcaccggccgtggaagaagcacggccgggcctatcgggaagatgaattgatccggatgattcaagagacaaacgcgtcggggcttataaccgaacttgatgaggtgtctcagcgtgttattgacatattgccggattccgcttttatcggtgtctgcagaggaatgccgtctaatgtggatattgcggcggcgactaaaagaaaaatccccgttttctttacaccggcccgcaatgcccaggccgttgctgaaatgtttatcgggaatgtgatttcatttttgcgtcatacgtattcttcccatcagtggctgaaggacggaaagtggaatggtgattatttgcaggcttacgtcaaattcagaggaaatgagctgacggggaaaacagtcggccttatcggtttcggagctgtcggacagagaatcgccaggctattggccgcttttgactgcaaggtgctttactatgatccatttgtccgtcatgaaaaccgggagtatgaaaaaacgacgattgaacgggtattttctgaaagtgatattgtttccgttcacttgccgcgcacagaagaaaccatcggccttatcggcgcccggcactttcaattgatgaaacaggaagctgtttttgtcaatacgtcaagagcggcggttacagacagggaagagctgctgcgggtgctgaaagaacggcggattaagggagcgatccttgacgtgttttatcacgaaccgcctgaatcttctgattatgatttgatctctttgccgaatgtgttcgcgactccccatttagcgggcgcaacatttgaagtggaagatcatcatgtgaagattttaaatgaagcgcttttcaaatggaaacaagatcaaacctattcaatacgtgaactttataacaaaagagaacttgaaacggaaggaggaggctgtaatggctgaacaaaaaggctaccttgtatttgacatcgggactgggaatgcgcgagtcgcggtcgtgactgccggcggcgaagtgaccgcgcttgaaagggaagacattgaatatgtgacggatccgctttatccggacggacgatatttctcaccggaagggttatggacgcaaatcagcgctatggcaagaaaggctattgccaagagccctcatattacattaatcggaatcacctcaacaagccagaggcagggaatcgttttgatcaataaagataaaaaggcatttctcggtctgcccaacattgataacagagggcgtgaatgggaaggcggaattgaggcagaagaagtgcatcagcaaaccggacgtcttccgagcgctttattttccgccatgaaacttgtcggattaaaagccagacagccgtctttatggaaagaagtgaagtgcatcacaagcatcagtgactgggtgacatttgagctgagcggaattttaagctatgaaccgtcacaggctgctgaaacactgctgtttgacgtaaggaaaaaggcgtggtcagagaaattatgcaacatcttcggtgtgccttctgccattcttccttcactcgtccgatctgggacggttgtcggaatgttaacgtttaagaaagcggcggtgctcggtctttctgaaagagtgcctgtgattgcaggcgggggagacacacagcttgccatcaaaagtgcagatgcaaagccgggagatatcgtcattgtatccggcacgacgacgccgattacaaagataacagcggagaccggaaccgaaagtttagagaatgcatggctgaattgccatacagaagaaggtgaatggcttcttgaaacgaatccgggtgtaacaggactcaattatcaaaaattaaaatccattttttatccgaatgaatcctacagcgtcatggaacgggaaatcgcaagtctgccgaaacatgatcatgcctgtatatctgcgttaggctcctatttatctcctgagaaaaacgcactggcaaaaggcggatttatttttgacgctccgctgtcccaaaacttaagcagagcccattttgtcaaagctgcactgctggaaatcgctttttcaatcaaatggaactatgaggcgttaacagaggcggcttccttttcacaagattatgtgaaggtgtgcggcggcggtttccaaagtgatgctttgacgcagtttcttgctaaccttcttcaaaagaaaatctataagagagaggggttcagccaggcatccgcaatgggagcggtgatgatttgcaacgaagctctcggtgtgaaagcagagctttcgacctgcacaaaggtaattgagccggaagcggatcagacggatctcttcctatatgaagaatggaaacatacccaaaaattatttactcattttcagccggcggtgaaagcctgacttggggatgagatgacaacatgaaagattgctgaggaggaacaaaaatgcttaataaaataggaattccgaaacagctcgcctggggatttttaggggtcgtgctgtttatgatgggggacggccttgaacaaggctggctcagcccgtttttagtcgaaaacggcttgacggtacagcaatcagcatccttgtttacggtttacggtatttctcttgctgtggcgtcgtggttttcaggagtctgcctcgaagccttcggcgcaaagcggacgatgtttatggggctgttgttttacgtcatcggaacagccgcgtttatcgcatacggatttgagaatcttaatttgccggtgatgtatgtcacgtattttattaaagggctgggttacccgctgtttgcctattcatttttgacatgggtgatttaccggtcgccgaaaaacaggctcagtacggcggtcggctggttctggattgcatattgctgcgggatgtttgtattcggtgcttggtattcaagctgggccatcaaatccttcggctatttgaatacgctgtggagttcaattttctgggtatgtctcggcgcgttttttgctttgattttaaatagggaccgctttgaaaagaaaaaggcagataagcgggaaaaggcgcaggaattaatgaagggaatcaccatccttgctgaaaatccgcgcgtgctctctggggggatcattcgaatcattaacagcatcggaacatacggatttccggtattcctcccgatgcatatggcgcagcacggcatttctacaaatgtatggctgcaaatttggggaacgatttttctcggaaatatcgtctttaacttaatcttcggcgcagtcggcgatgccttcggctggaaaaagactgtcatgtggttcggaggagtgggctgcggcatttttactcttttattatattatgctcctgttgtatcacatgggaatttgctgttcgtcagcattgtcggttttatatggggagggctcctcgccgggttcgttccgatcggggctatcgtgccgacggcggccggcagcaataaaggtgctgctatgtctgtgttaaatctggctgcgggcctgtcggcatttgtcggccccgcgcttgcctgggcgttcatcgggcttgtcggcgcacaaggcgttgtatggattttcgcagcgctctatttcgtaagtgcgatcttgacaaatcaaatcaaaatacctgaagagaaaacggcaaaacacaataaagcattgcctgaatacgcttcttaacagcagcgccccgaaaattcggggcgtttttttacggctgatgaagaaacccggcaaaccgctgaatttgttcacgtaacgattgtttgttttcgtgaaattgtttgaaacgatgtccgtttgctccggacggatgcgggaagccttccagaatgaccgcatggcccattctgcggttcttcttcagcgtgcggcaggctgattctgctgcttttccgagagggataagcagaatgtcttttttcatcatttctatttcatccggaaaacatgtcagcgcgtaacggctgagaagagctgatctgctgatggccggccggtgtcccgtatagtttttctgtttataaaaaacagggtgtttgataacggatgtcgtatgaagcagctccctttttgaatcaaaaaaccgggatgaatcctcaacgtgaagcgcggccggcagaccgcattcattaagcatttcgatgatgtgctgcctcatggaaccggaaagtccggccgctttttttgtctcatatgctatcacctcaagagattcgccgttttttaaaagctgtgccgctgctttgtacgcccgctgcatctgaaaaaaaccgggtgtaattccggagatgacaaccgcagcatgtgggttgatatactcattatgaggcgaataatacatatccagatctccgtccttggctaaatggaactccgaagtcagcaaatccgattttgtaaatcctcccgaagatgataatgctttaagctgctgcaaaaaatgcgcaagccgctcacgatcgcaaatcatgttatgcctccttgaatccgccagtttctcttagtgtcatcaaaaacgtcggatgacatgcaggctcataaaccgcttttaccggcgttccagagcattttcaggacgtgaggcgttcctttaacttcggctgccgtcgtttgcacggctgtttttttagtaagaaagtcttcctgcagttctttctgcttttgtgataacaaacgggtttctgttttgatttcttcaacggacgtctgcatggacgctgtcacggcgttaatcttctttatatcaggcgctgtgtttcttttaaaatgcacggcggatacggctgcataaattaaagcggcagccgcaacggcagcactgatatacaaaatgatgatcatctgcttttcactcctttttttcagttgataccctttacggatcgtgctgaatcattttatttgctaattgttttttttctgcttataatgtgaaatcgtacataaggacattcagaaagggtgaaagacatggaaagcttacaaaacaaaacggctcttatcacgggtgcgggcagaggaatcggccgcgccgccgctatcgctttagccaaagaaggagtcaatatcggtttaatcggccgtacagaagcaaatgtcgaaaaggttgcggaagaagtgaaagcccttggtgtaaaggcatcattcgctgctgccgatgtaaaaaaccaaaaagaggttgaacaagccgtctcttctattaaagaagaactcggtgaggttgacatcctgattaacaatgccggaatcagcaaattcggcggatttttggatcttacgcctcaagagtgggaagacatcattcaagttaatgtaatgggtgtataccacgtgacacgcgccgttcttcctgaaatgattgagagaaaatcaggagatatcattaatatttcttctacggcgggccaaagaggcgccgcggcgacaagtgcgtacagcgcttctaaatttgccgttctcggtctgaccgaatctctcatgcaggaagtcagaaaacacaatatccgtgtcagcgcaatgactccgagcacggttgcaagcgacatgtctattgaattaaatctgacagacggcaatccggaaaaagtcatgcagcctgaggatcttgcagaatatatggttgctcaattgaaattacacccgcgcattttcatcaaaactgccggtttgtggtcaactaatccttaatcaaaaggggacctgtctttgtgacgggtcttttttgttttcgcaacccgattaaataggcataaagatccgtttttgcagaaaaaagagtgaaaaagaaaccgatatcagctataattaaactaaataaactatgtaccaaatgttcaataagattatttttccccgcatccaaaaaacaaatcaatataaaccaaactgtccgaacaataaaagggaaaacgggatataaagagaatatttagtacatggaataatttgttagaaggaagggtgggcacatattgaaagaagaaaaaagaagttcaaccggttttttagtaaaacaaagagcctttttaaagctttacatgattacaatgacagagcaggaacggctttacggactgaagcttctcgaggtgctgcgttcggaatttaaacccatcggttttaagccgaatcataccgaggtgtaccgttcacttcacgaacttttggatgacgggattttaaagcaagtaaaagtgaaaaaagagggagccaaactccaggaagtcgttctctatcaatttaaagactatgaagctgcaaagctttacaaaaaacagctgaagacagagcttgaccgctgcaaaaagctgatagaaaaagccatttcagataatttttaaatccggccggaacgctcccggcctcccgggctcaaaaggtttgttctgtgattcattatacataataacaggctcggaacaatacatatcaataaaacctccaaacttgacatcgactcctgaagtggtaacataaaaaacgtgtgaaaaatacgaacaaaatacgaacaagggagatgttaccgatcttagatcaaaagaaagttgcttttatcggagcaggatcaatggctgaaggaatgatatcaggcatggtccgcgcaaaaaaaattcccaaccaaaacatctgcgtgacaaaccgccgcaatacagagcgactcgctgaattggaacatcaatacggaattcaaggcattgcttttgacagcatgaaaaccgaagacattgatgtctttattttagccatgaaaccgaaggatgctgaaatcgctcttgctacgctgaaacggcgtattcaacctcatcaaatcatcctgtctgttctggcaggcataacaacctcatttatacaacaatcattacatgaccgtcagccagttgtaagagtgatgccgaacacatccagcatgatcggcgaatcggcaacagctgcggctttcggagaccatgtctcttacggttcagcaaaaaccgcggtatctcttttggaatgcctcggggaagtgtacgtgatcaaggaagatcagatggacattttcaccggcatcgcaggcagcggaccggcgtacttttattatttaatggagtttattgaaaaagcaggtgaagaagccggcttagacaaacggctgtcccgcaaaatcggggcgcaaacgttattgggcgctgcaaaaatgctgatggaaacgggtgaaaaaccggatgtgcttcgggaaaacatcacctctccaaacggcacgacggaagccggcctcgatgcgctcaggtcagaaggcggcggagaagccattgccaaagccattaaacacgcgaccgaacgttctattgagatcagcaaaacaattgaaaaaacggcagcactataatcgttaaaaaacaggagtgatacagtgacgtctcggacgaagatcaaaagagtcgcggtgaaaatcggaagcagctcactgacgagcctgcacggggaaatcagcagaagaaagctggaagcattggtggatcaaatcgcacagctgaaggacagcggctatgaagtgattttaatatcttccggcgcagtggcggcaggttatcggaagctcggatttattcagaaaccggaaggcctccctgaaaaacaggcttctgcttccatcgggcagggattattaatggaggcttactcaaagctgtttttagcgcacggttatgtcgcatcacaaatattaattacaagaagcgatttttccgatgaataccgctaccataatgtgcgcaatacgatgaacgtccttttggaacggggcattattccgattattaatgaaaatgacacggtcacagtcaaccggctgaaattcggagataacgatacacttgcagcgaaggtggcaggtttaattgatgccgacatgcttgtaattttatcagacattgacggtttatatgatgataatccgcgcagcaacccgaaagcgaaaagaatcagacatgtaagtgacatcactccggaaatagaagcaagcgcgggagatgccgggagtgaaatgggaaccggcggaatgcgttcgaaactggatgcttttaagattgtgatggcctccggtattaaaggctttctcgggcaggctaacattccggacattctgcttcaagcggtagatgaggcggctgaaggaacttattttgaagcggaaggaaccctgccgttaaaccacaaagaacaatggcttgcatttaattccggccccgaaggcgaaattgtgatggaaaagaaaagcagccgcgatgtcgcaaacggaaatatggcgctgtcaccgcaggatatcgaacagattaagggcagattcagcagcggagcggttgtcaggctgcttgatcagcagggagaagagctcggactcggcatcgtcaactattcctcagcccagctgaagacatttaaagaaacgcctcacaaacagaccgatcaatcagtcattgatccggaagcgtttgtctgccacgttgaactatccattccgatcggctgagaaagatctataaaaatatgaaaaagcccgaggcttcgttttgaagctcgggtttgttttttattgatattgttcaagtttggagaaaaattgaatgacaaaatgatagaaatcatttgcagacggagccagttctcttccttttggtttaataatgcctacggtccgcttcacttgaggaaattcaatcggaattttgaccgtgaaccggggtgtggtttctgcaaaggtgctttcaggcaataaagtaactcccatccccgcggagactaatcctttaatggcatctaaatcctcgccttccgtcgatacaagcggcgcaaagccggcctgtctgcaagcgtcaatcgccatgtttcggagaataaacccttcaggaaataaaacgaattggtccccgcgcagatcaattaaatgaatatttttctgtttggcaagcggatgatgcagcggaacaagcgcgtaaatcttttccgtgaataagatattgcctgttatgtcggggaattccgtcggaacggggccgagcagcgcagcatctatatccctgtttcttaccgcttcgattaaaaacttataagaaccctggcggagcaaaaactcaacgttcgggtattcctctttaaatgccgaaatcacagtcggcaaaagctggcttgcaaggctcgtcggaaatcctattttgacggttccgcgattcggatcaagatattcatcaatttgttccttcgcataatcaattgctttcatcgccgttttaacatgttctaaaaattgtttgccgatcggcgttaatttaatatttctgccttcccgttcaaataaagtgactttcagctcttcttcaagatttgcaatctgccggctgatggcggattgtgcgacatgcagatgatcagccgcttctgacacatgttcccgttctgctacctccataaaataccgaagctggcgtaattccattgcgttcacacccatctatctcattttgagatgtatttgatctaaattatatattgtttatattgttttgaaaacttacaattaatttaaagttgtcagattttatgaccgataattaacggaaactgatcgggggagaggaattatgacttacaatcaaatgccgaaagcacaaggtctctaccgtccggaatttgagcacgatgcatgcggaatcggcttgtatgcccatttaaaagggaaaccttcacatgacattgtcaaaaaaggactgaagatgctttgccagctggatcacagaggaggacagggcagtgatccgaatacgggtgacggcgccggcctgatggttcagatccctgatgctttttttaagaaagagtgcggagaaatgaagctgccggaaaaaggccgttacggggtaggaatggtctttttctcgcaaaatgaagaggaaagaaaaaagatcgaaaaacaggtgaatgcattcattgagcaggaaggacagatcgttctcggctggagaaccgtccctgtaaatgtcggaaaaatcggaacagtggcacaaagcacttgcccgtatgtgcgtcaagtatttatcggagccgcaaacgatttgaaagacagccttgcttttgaacgcaaattgtatgttatccggaagcaggctgaaaattggggcgttcaagaacagcttgatttttacttcgcaagcctgtcaagccagactattgtttataaagggttgttaacgcctgagcaggttgacgctttttatttggatttgcaggatgaaaccttcgtatctgcattttcactcgtgcattcaagattcagcacaaatacctttcctacttgggaacgtgcccatccgaaccgctatctgattcataacggagaaatcaatacgctccggggcaacatcaattggatgagagcgagggagcagcagttcgtttcagaaagcttcggagacgatcttcacaaagtgctgccgattttaaatgctgagggcagtgactcatccattcttgataatgcgtttgaatttttcgtgatggcggggcggaaaccggcacatacggcaatgatgctgattccggaaccatggacggaaaacactcacatgtctaaagcgaaacgggctttttatgaatatcacagctctttaatggagccgtgggacgggccgaccgccatttcgtttacggacggaaaacaaatcggcgccatccttgaccgtaacggcctgcgtccggcacgttactatgtgacaaaagatgaccatattattttctcatctgaggtcggcgttattgaagtggagcagaagaacattcttcataaaaaacgtctggagcccggaaaaatgctgctcattgacttagaggaaggccggattatttcagatgaagaagtaaaaacagaaatcgccaatgaattcccgtatcaaaaatggcttgaagaagaattggttcaagtgaatcctgacccggaaatccgggaagaggaacaattcgatgatcttctcgtccgtcaaaaagcgtttggctatacgtatgaagatatccagaaatatttaattcctgttattaaagaaggcaaggacccgctcggctctatgggaaatgattcgccgctcgccgttttatccgatcgcgcccaatcactgtttcattactttaaacagctgtttgcgcaagtcacaaacccgccgattgacgcgatccgcgagcagcttgtgacctctacggtgacatggcttggggctgaaggtgatctgctgcatccgagtgaaagaaatgcacgccgcataaaattgtatactcctgtattatcaaacgaacagttttatgcgctgaaaacacttgtgcaccctgatattaagagccagaacatccgcacgctgttttccgatgacctggaaaaaggcctgaaggatttgtttcagcaagcggaaaaagcgatcaaggaaggcgtatctctgttaattttatctgacagggcaatgagtaaggaattgacgccgattccgccgcttttggccgtcagtgcgctgcatcagcatttgatccgtcaaggcctgcgaacaaaagcaagcattatcgttgaatccggggaagcgcgtgaagttcatcactttgcggctctcatcgggtatggtgccgatgctgtcaatccgtatttgacttatgctacgtataagcaggaaatcgatgaaggccggcttgatattccgtatgaagaagctgtcagcaaatacggaaagagcgtaacagaaggcgtcgtgaaagtgatgtcaaaaatggggatttcaactgtgcaaagttacaggggcgcccaaatttttgaagcggtcggcatcggtgaagacgttatcgccaaatactttaccggtactgcatctcagcttggcggaatcgatatcgagacgattgcgcaagaagcgaaacagcgccatcaagcggcgtacaaggatgattacagccaaactcttgatcctggaagtgaattccaatggcggaacgggggagagcaccacgctttcaacccgaaaaccatccatacgctgcaatgggcctgccgaaaaaatgattacagcttgtttaagcagtattctcatgcagcggatgaagaacgaatcggatttttacgcaatctgttcgccttcaaagaagaccgcaagcctttaaaattagaggaagttgaatcagctgcgtccatcgtgaaacgttttaaaacaggagcgatgtcattcggttcattaagcaaggaagcccatgaggctttagcgatagcgatgaacaggcttggcggaaaaagcaacagcggagaaggcggcgaggacccgaaacgtttcgttccggatgaaaatggcgacgacagaagaagtgcgattaaacagatcgcctccggccgtttcggcgtaaagagccattatctcgtcaatgcggatgaattgcagatcaaaatggcgcaaggagcgaagccgggagaaggcggtcagcttccggggaacaaagtatatccttgggtcgcggatgtccgcggttctacaccaggtgtagggctgatctcaccgcctcctcaccatgatatttattcaattgaagatttggcgcagctgatccatgatttgaaaaatgcaaatcgaagcgcgcgaatcagcgtcaagctcgtgtcaaaagccggtgtcggcacgattgcggccggtgtggcaaaaggcactgcggatgtcatcgtcatcagcggctacgatggcggaacgggcgcatcgccgaaaacgagtattaaacataccggtcttccgtgggagcttggtcttgcagaagctcaccaaacgctgatgctgaacggtttacgggatcgcgtggtattggaaacggacggtaagctgatgacaggccgagatgtcgtgatggccgccttgctcggtgcggaggaattcggctttgctacagcgccgcttgtcgttcttggctgcatcatgatgcgcgcctgccatttagatacatgtcctgtaggtgtcgcgacgcaaaatccggagctccgcaaaaaattcatgggcaatcctgaccatatcgtaaattacatgctgtttgtcgcagaagaagtgcgtgaatatatggcgcagttaggctttaagacgcttgatgaaatgatcggacggacagacgttcttcatgtcagtgaacgtgcgaaagcgcattggaaagcgggccagcttgatttatccacactgctgtaccagcctgaaggcatacgcactttccgtacggcgcaaaaccataaaatcgacgagtcgcttgatatgacggttattcttccggcggtgcaggctgcaattgaagccggtcaggaagcggaagctgaaatcaagatcaataatacaaaccgcgtagccggaaccgtgacgggaagtgaaatttctaaacgctacggagcggaaggcctgccggatgatacgatcagacttcattttaccggatcagccggacagagtttcggtgcatttgtccctaaagggatgacgcttcatttgaacggggattcaaatgactacgtaggcaaagggctttcaggcggaaaaatcatcgtgaaagcgcctgatgccttcaattatgaaacacacgataacgttattatcgggaacgtcgcattttacggagcaacaagcggggaagcgtacattaacgggcgcgccggtgaacgttttgcagtccgtaacagcggagtcaatgtcgttgtagaaggtatcggagaccacggctgcgaatacatgacaggcggccgggttgtcgtcctcggcgaagtcggcaaaaacttcggggcgggaatgtcaggcggtatcgcatacgtcctgagtgaagatgccaaagcatttaaacgcaaatgcaacatggaaatgatttcatttgaaaagctgacggatgaggcggagatcaaagaagtgcaagaaatggtcaaacggcatgcggcgctgacaaacagcaaaaaagccgcaaatctcctggacaattgggaaaaagccgcagaaacctttatcaaagtcattccgaaaaactataaacaaatgctcctcagcatcgaagaacaaaaagcggcgggtttatcagaagaagacgcaattatgtatgcttttgaagccaatacaaaggttcagcaaacgcctgccaaagatcaaaaacaagcggtagtacagtaagaaaggggagaggaacatggggaaaccaactggattcatggaagaaaaacgagaaaaaccggctgagcgggaccctctcactcgcttaaaggattggaaagagtattcggctccattttcagatgaagcgtcaaagcggcagggggcgcggtgtatggattgcggcacaccgttttgccaaatcggcgctgatatcaacggttttacctccggatgcccgatttataatctgataccggagtggaatgacctcgtctatcgggggcgctggaaagaagccttggagcgccttctgaaaacgaataactttcctgaattcacagggcgggtctgtcccgctccttgtgaaggatcttgtacgctggccatttcagatccggctgtttcaattaaaaacatcgagcggacgatcattgacaaaggttttgaaaatggatggattcagccgagaattcccgcgaaacgcacaggtaaaaaagtcgctgtcgtcggttcaggcccggcaggtctggcaagcgctgatcagctgaatcaagccggtcattccgtaacggtctacgagcgtgccgacagagccggcggcctgctgatgtacggcattccgagcatgaagcttgagaaaaatgtcgtcgaacgccgtattaagcttttgacgcaggaaggtatagattttgtgacaaataccgaaatcggcgttgatataacggcagatgagctgaaagaacaatttgatgccgtcattttgtgcacaggcgcccaaaagcagcgcaatctgctgattgaaggccgggaagcaaaaggcgtccattatgcgatggactatttaacactggcgacgaaaagctatttagattccaacttcaaagacaaacaatttatagacgctaaagggaaagatgtcatcgtgatcggcggaggagacacaggagctgactgcgtggcaaccgcgctgcgtcaaaaagcgcgcagcgtgcaccagttcgggaaacatcctaaacttcctcagacgcgcacgaacgacaatatgtggcctgaacagccgcacgtctttacccttgaatacgcctatgaagaagcgcaggcaaagttcggcaaagacccgagagaatattcaattcaaacgacaaaaatggtggccgataagcagggccgcttacaagagatccacaccattcaaatggaaaaagtcagaaacgaattcggaaagtatgaatttcatgaactgcccggtacagaaaaagtctggcctgctcagctggtgttcatcgccatcggttttgaagggacagaacagccattattgaaacagttcggagtcgattcggcaaatcataaaattcaggcggcatatggggattataaaacgaatgttgacggtgttttcgccgcaggggatgcgagaaggggccaaagcctgattgtatgggcgattaatgaaggccgggaagcagcgcgcgaagtcgacagttatttaatggggagcactgttttaccgtaaataaaggggtttatttataaaaccggctgggatcagccggtttttcgtattgaaatggaacctccttcttcttgtattggtcatataaaggtaatgtggaaatggaggataaatatggaattttgttttacagagcggagagattgtttttttccgcagactgatacgatttgcaagccttgcgcaatcgatcagggtgctgctgacggcggaagtcatcgctgccgtttaaaatgacgccttaaaaaacatgacgggctctgtgtgtctgcagtcgatttgcgggcagattttaatcgatgaagaaaaacatattgaatttcaagcggaaacgcttaaaaacaaataagggaacggacgggtccgttcctttttttagacatctatacgaaagccgatattgccgaactgccgtccttcccgcattctgttaaaagcgggagctgcttcactgagagggtacatgcggtcgataatgggacggagctcgcagcggtttatcaattccagcatatccgcgaattcctcattgcttcccattgatgtaccgagaatatgaatctgcggaaaaaacagcgagcgaatgggaaatccgagctgatcgcctgaactggcgccgaatgttacgatccggccattcggtttaataatgtcaagatagtgttgatataaagcggggcctacaccgtcaagtatgatatctgctttttcgccattcagcgcctcattccagtcaccgtagctgtcaatcgcccggtctgcaccgtatgacagtgcggtttgttttttgttttcactgcgggaggtgacgctgactgtcgctccgatagcttttgccattaataaggcatatgttgccacgccgcttccgatgcccggaaggataaggtgttcgcctttttttaattgtccttttgtaaataaggcgcgataagcggttaatgctgataacggcaggacgcccgcttcctcccaagtcaggtgttcgggttttaaaacggcattttccgcaggaacgatgacataaggtgaaaatgttccgtcgctcggaccgcctaaaatatcagggacggctggtacgtcctcaacagtcttccaattcagtaccgggttgatgatgacttctgcattcagtaaatgagaccggacgccgtgtcctatttcggttacgattcccgcgccgtctgaaccgagaataaattcatggtttccggtttcgtgttttttcattaaaaacaaatcacgatggtttaatccggctgttttcagctttatttttacttcgccgtttcccggccttttgtcaggtgcctgcctgaaattaaagccattttcgtgtatgataaggacattcatgattcttctctcctttatgattgatgagaaaaattttacaggctgtatcagctgcagtaaataaatgaaaattgatagccggctatcaataaaaatcatagcaagaaggtgcccttagatggaaagcggagacttaaagatttttcaggctgtcgcccgcaaaggaagtatttcaaaggcggcagaaagcctgcattatgttcaatcaaatgtgacaaaccggattcagcagctggaacggcaattgcaaacacagcttttttaccgcacaaatcggggaatgacgctgacgccaacaggtgaaaacttattaaaagacgcagacagaatccttcaattgctgcatgaggcgcaaaaaacagcgcgagaggcaggcgatccgaacggcccgcttcgaatcggttctcttgaaacggcggcagccgtccatctccctcaatttttcacggagtattgcagccgctacccgaaagtacagctgtctctgtcaaccggtgatacacataccttagtgcagcgcgttctacactatgagctggacggcgcttttgtttacggaccggtcgaatatgaagatcttgagcaagtcgctgtatttcaagaagaattggtcttggtttcaaataagcgggaaggcagtttgcaagacttgctgcgagagccgattctgtattttgccgcgggctgttcgcaccgccgcaaaataaaaaacatactgaaagaagaggcagtgcccgcacataaaatcattgaattcggtacgttggaagccattattggggcggtgcaggcggggatgggggtctcctttctgcctgcatcagccgtccgttattttcaaaacaggaaaaatctttttcttcatgagcttcctgaacattttcggaatatgaatatatcattcatctaccggagtgatttatttttaacatcggcgtttgaagaactgctgaatggattaaaaacattatcgaacagaagatgagaaaacaggacagctgtgtacgccaattttttttcgttccggtttttctcaaaaagaaagcgggtatccgggctgagctcgatcagcgtgatgaaaaactcggctataaaatcagagaagcacaaatgaaaaaaataccgtatatggcggttgtgggagatcaagagtgccgccaccattctgtacatgtaaggcaatacgggcgggaaaacacatttgaagagaatgtgagtgattttatttcccggatcataagagagacaaaacaaaaaatagagattcaagaaaaataacattgacatatcgcaaaatcacgatataataaagcgtatgaaacctattgatgtttttaaagcgttgtctaatgagtcacggcttgagattttacaatggctgaaagagccggaccgtcacttcgcaccgcatgatggcattgatatgaatgagatcggagtatgtgtcagccagatcaccgataagcttcagatgacacagtcaacggcgtctcaatatctttccattcttcagcgcgcaggccttatccaaacaaaacggattggcaaatacacctattataaaagagatgaagatgcgataaaggcgatggccgattattttcagcgcgaaatgtagggctgaatcctttagaagagggattcagtttcttttttcgactacacatcgacatattgcgatttgtttctgtttgttcaattctttatatcgatatatcacaatatatctttatataaattatcaatgaaggagtgtgtcaggtgcaaaatacctggaagatttacattttggcaattatcagctttttagtggggacgtctgaatatgtgatatccgggatgcttgataaaattgcaggttccttgggagttactgtggcagcagcagggcagctgattacgatt
